US008383388B2

(12) United States Patent
Oyhenart et al.

(10) Patent No.: US 8,383,388 B2
(45) Date of Patent: Feb. 26, 2013

(54) MODIFIED COAGULATION FACTOR IX POLYPEPTIDES AND USE THEREOF FOR TREATMENT

(75) Inventors: Jorge Oyhenart, La Pampa (AR); Xavier Gallet, Champhol (FR); Gilles Borrelly, Combs la Ville (FR); Thierry Guyon, Palaiseau (FR); Manuel Vega, Vigneux-sur-Seine (FR); Lila Drittanti, Vigneux-sur-Seine (FR)

(73) Assignee: Catalyst Biosciences, Inc., South San Francisco, CA (US)

( * ) Notice: Subject to any disclaimer, the term of this patent is extended or adjusted under 35 U.S.C. 154(b) by 1113 days.

(21) Appl. No.: 11/818,985

(22) Filed: Jun. 15, 2007

(65) Prior Publication Data

US 2008/0102115 A1    May 1, 2008

Related U.S. Application Data

(60) Provisional application No. 60/815,113, filed on Jun. 19, 2006.

(51) Int. Cl.
| | | |
|---|---|---|
| C12N 9/64 | (2006.01) | |
| C07K 14/00 | (2006.01) | |
| A61K 38/48 | (2006.01) | |
| C12P 21/00 | (2006.01) | |
| C12Q 1/37 | (2006.01) | |
| C12N 5/10 | (2006.01) | |
| C12N 15/00 | (2006.01) | |
| C12N 1/21 | (2006.01) | |

(52) U.S. Cl. ...... 435/226; 435/23; 435/69.1; 435/320.1; 435/325; 435/252.3; 530/350; 424/94.64

(58) Field of Classification Search .................. 435/226, 435/69.1, 23; 424/94.64; 530/350
See application file for complete search history.

(56) References Cited

U.S. PATENT DOCUMENTS

| | | | |
|---|---|---|---|
| 4,044,126 A | 8/1977 | Cook et al. .................... 514/180 |
| 4,364,923 A | 12/1982 | Cook et al. ...................... 424/46 |
| 4,414,209 A | 11/1983 | Cook et al. .................... 514/180 |
| 4,522,811 A | 6/1985 | Eppstein et al. ................ 514/12 |
| 4,770,999 A | 9/1988 | Kaufman et al. ............. 435/69.6 |
| 4,892,538 A | 1/1990 | Aebischer et al. .......... 604/891.1 |
| 4,994,371 A | 2/1991 | Davie et al. ........................ 435/6 |
| 5,033,252 A | 7/1991 | Carter ............................. 53/425 |
| 5,052,558 A | 10/1991 | Carter ............................. 206/439 |
| 5,171,569 A | 12/1992 | Anson et al. ............... 424/94.64 |
| 5,283,187 A | 2/1994 | Aebischer et al. ............. 435/182 |
| 5,323,907 A | 6/1994 | Kalvelage ...................... 206/531 |
| 5,521,070 A | 5/1996 | Meulien ........................ 435/69.1 |
| 5,580,560 A | 12/1996 | Nicolaisen et al. ........ 424/94.64 |
| 5,639,857 A | 6/1997 | Zimmermann ................ 530/384 |
| 5,837,679 A | 11/1998 | Wolf et al. ..................... 514/13.5 |
| 6,027,913 A | 2/2000 | Sommer ....................... 435/69.1 |
| 6,100,061 A | 8/2000 | Reiter et al. ................. 435/69.1 |
| 6,277,618 B1 | 8/2001 | Kopetzki et al. .............. 435/219 |
| 6,315,995 B1 | 11/2001 | Pinsky et al. ............... 424/94.63 |
| 6,531,298 B2 | 3/2003 | Stafford et al. ............... 435/69.6 |
| 6,624,289 B1 | 9/2003 | Bajaj ............................. 530/328 |
| 6,761,903 B2 * | 7/2004 | Chen et al. ...................... 424/451 |
| 6,762,286 B2 * | 7/2004 | Nelsestuen ................... 530/380 |
| 6,936,441 B2 | 8/2005 | Reiter et al. ................. 435/69.6 |
| 7,125,841 B2 | 10/2006 | Sheehan ....................... 514/13.5 |
| 7,220,718 B2 | 5/2007 | Alpan et al. ....................... 514/2 |
| 2003/0129203 A1 | 7/2003 | Vega et al. |
| 2003/0129584 A1 | 7/2003 | Vega |
| 2003/0134351 A1 | 7/2003 | Vega et al. |
| 2003/0166130 A1 | 9/2003 | Baker et al. ................... 435/69.1 |
| 2003/0175694 A1 | 9/2003 | Vega ................................. 435/5 |
| 2003/0203845 A1 | 10/2003 | Knudsen et al. ................ 514/12 |
| 2003/0224404 A1 | 12/2003 | Vega et al. ......................... 435/6 |
| 2004/0102388 A1 | 5/2004 | High et al. ....................... 514/44 |
| 2004/0110675 A1 | 6/2004 | Sheehan ......................... 514/12 |
| 2004/0126856 A1 | 7/2004 | Bajaj et al. ................... 435/184 |
| 2004/0132977 A1 | 7/2004 | Gantier et al. |
| 2004/0133930 A1 | 7/2004 | Cooper et al. ..................... 800/7 |
| 2004/0146938 A1 | 7/2004 | Nguyen et al. ................. 435/7.1 |
| 2004/0209829 A1 | 10/2004 | Alpan et al. ..................... 514/44 |
| 2004/0254106 A1 | 12/2004 | Carr et al. ....................... 514/12 |
| 2005/0100982 A1 | 5/2005 | DeFrees et al. ............... 435/68.1 |
| 2005/0164932 A1 | 7/2005 | Haaning et al. ................. 514/12 |
| 2005/0202438 A1 | 9/2005 | Gantier et al. |
| 2005/0250688 A1 | 11/2005 | Pinsky et al. ................... 514/12 |
| 2006/0002916 A1 | 1/2006 | Ruggles et al. ............. 424/94.63 |
| 2006/0020116 A1 | 1/2006 | Gantier et al. |
| 2006/0020396 A1 | 1/2006 | Gantier et al. |
| 2006/0024289 A1 | 2/2006 | Ruggles et al. ............. 424/94.64 |
| 2006/0040856 A1 | 2/2006 | DeFrees et al. ................... 514/8 |
| 2006/0195268 A1 | 8/2006 | Vega |
| 2006/0247170 A1 | 11/2006 | Guyon et al. |

(Continued)

FOREIGN PATENT DOCUMENTS

| | | |
|---|---|---|
| WO | WO 95/017421 | 6/1995 |
| WO | WO 99/49880 | 10/1999 |

(Continued)

OTHER PUBLICATIONS

Branden et al., Introduction to Protein Structure, Garland Publishing Inc., New York, p. 247, 1991.*
Witkowski et al., Biochemistry 38:11643-11650, 1999.*
Seffernick et al., J. Bacteriol. 183(8):2405-2410, 2001.*
Murphy et al., Gen Bank accession No. Q8K3U6, Jun. 2004.*
Aguilar-Martinez et al., "Factor IX gene mutations causing haemophilia B: comparison of SSC screeningversus systematic DNA sequencing and diagnostic applications," Human Genetics 94(3):287-290 (1994).
Ahmad et al., "Comparative platelet binding and kinetic studies with normal and variant factor IXa molecules," Journal of Biological Chemistry 265(34):20907-20911 (1990).

(Continued)

*Primary Examiner* — Delia Ramirez
(74) *Attorney, Agent, or Firm* — McKenna Long & Aldridge LLP; Stephanie Seidman

(57) ABSTRACT

Provided are modified factor IX (FIX) polypeptides and methods of generating modified FIX polypeptides. Also provided are pharmaceutical compositions, including compositions formulation for oral administration, that contain the modified FIX polypeptides, and methods of treatment using modified FIX polypeptides.

65 Claims, No Drawings

U.S. PATENT DOCUMENTS

| | | | |
|---|---|---|---|
| 2006/0251619 A1 | 11/2006 | Borrelly et al. | |
| 2006/0264373 A1 | 11/2006 | Nelsestuen | 514/14.3 |
| 2006/0264616 A1 | 11/2006 | Nelsestuen | 530/383 |
| 2007/0042494 A1 | 2/2007 | Kafri et al. | 435/456 |
| 2007/0093443 A1 | 4/2007 | Madison et al. | 514/44 |
| 2007/0172459 A1 | 7/2007 | Gantier et al. | |
| 2007/0224665 A1 | 9/2007 | Gantier et al. | |
| 2007/0249532 A9 | 10/2007 | Guyon et al. | |
| 2007/0254838 A1 | 11/2007 | Gantier et al. | |
| 2008/0003202 A1 | 1/2008 | Guyon et al. | |
| 2008/0026993 A9 | 1/2008 | Guyon et al. | |
| 2008/0038224 A1 | 2/2008 | Guyon et al. | |
| 2008/0075672 A1 | 3/2008 | Gantier et al. | |
| 2008/0159977 A1 | 7/2008 | Gantier et al. | 424/85.1 |
| 2008/0194477 A1 | 8/2008 | Gantier et al. | 514/12 |
| 2008/0260820 A1 | 10/2008 | Borrelly et al. | 424/463 |
| 2008/0274081 A9 | 11/2008 | Gantier et al. | 424/85.5 |
| 2009/0047210 A1 | 2/2009 | Ruggles et al. | 424/1.11 |
| 2009/0053147 A1 | 2/2009 | Gantier et al. | 424/45 |
| 2009/0098103 A1 | 4/2009 | Madison et al. | 424/94.64 |
| 2009/0123452 A1 | 5/2009 | Madison | 424/94.64 |
| 2009/0123974 A1 | 5/2009 | Gantier et al. | 435/69.51 |
| 2009/0131318 A1 | 5/2009 | Gantier et al. | 514/12 |
| 2009/0136477 A1 | 5/2009 | Nguyen et al. | 424/94.64 |
| 2009/0291890 A1 | 11/2009 | Madison et al. | 514/12 |

FOREIGN PATENT DOCUMENTS

| | | |
|---|---|---|
| WO | WO 01/32711 | 5/2001 |
| WO | WO 01/44809 | 6/2001 |
| WO | WO 01/86291 | 11/2001 |
| WO | WO 02/40544 | 5/2002 |
| WO | WO 03/018820 | 3/2003 |
| WO | WO 03/023032 | 3/2003 |
| WO | WO 2004/022593 | 3/2004 |
| WO | WO 2004/022747 | 3/2004 |
| WO | WO 2004/031733 | 4/2004 |
| WO | WO 2005/100556 | 10/2005 |
| WO | WO 2005/110453 | 11/2005 |
| WO | WO 2006/018204 | 2/2006 |
| WO | WO 2006/020580 | 2/2006 |
| WO | WO 2006/024547 | 3/2006 |
| WO | WO 2006/048777 | 5/2006 |
| WO | WO 2006/120580 | 11/2006 |
| WO | WO 2007/047995 | 4/2007 |
| WO | WO 2007/014219 | 6/2007 |
| WO | WO 2007/110231 | 10/2007 |
| WO | GB 2007/004520 | 11/2007 |
| WO | WO 2007/135182 | 11/2007 |
| WO | WO 2007/149406 | 12/2007 |
| WO | WO 2008/045148 | 4/2008 |
| WO | WO 2008/127702 | 10/2008 |
| WO | WO 2009/051717 | 4/2009 |
| WO | WO 2009/126307 | 10/2009 |
| WO | WO 2009/130198 * | 10/2009 |
| WO | WO 2009/137254 * | 11/2009 |
| WO | WO 2010/012451 | 2/2010 |
| WO | WO 2010/029178 | 3/2010 |

OTHER PUBLICATIONS

Aktimur et al., "The factor IX γ-carboxyglutamic acid (gla) domain is involved in interactions between factor IX and factor Xia," Journal of Biological Chemistry 278:7981-7987 (2003).
Altschul, S., et al., "Basic local alignment search tool," Journal of Molecular Biology 215(3):403-410 (1990).
Arruda et al., "Posttranslational modifications of recombinant myotube-synthesized human factor IX," Blood 97(1): 130-138 (2001).
Beech, et al., "Further characterisation of a thromboembolic model of stroke in the rat," Brain Research 895:18-24 (2001).
Bertina et al., "Mutations in hemophilia Bm occur at the Arg180-Val activation site or in the catalytic domain of factor IX," Journal of Biological Chemistry 265:10876-10883 (1990).
Bond et al., "Biochemical characterization of recombinant factor IX," Seminars in Hematology 35 (Suppl. 2): 11-17 (1998).
Borkakoti, N., "Matrix metalloproteases: variations on a theme," Progress in Biophysics and Molecular Biology 70(1): 73-94 (1998).
Bottema et al., "The pattern of spontaneous germ-line mutation: relative rates of mutation at ornear CpG dinucleotides in the factor IX gene," Human Genetics 91(5):496-503 (1993).
Bottema et al., "Missense mutations and evolutionary conservation of amino acids: evidence that many of the amino acids in factor IX function as 'spacer' elements," American Journal of Human Genetics 49:820-38 (1991).
Bowen, D., "Haemophilia A and Haemophilia B: molecular insights," Molecular Pathology:MP 55:127-144 (2002).
Bristol et al., "Propeptide processing during factor IX biosysthesis," Journal of Biological Chemistry 268:7577-7584 (1993).
Buchan et al., "A new model of temporary focal neocortical ischemia in the rat.," Stroke 23:273-279 (1992).
Carillo, H. and D. Lipman, "The multiple sequence alignment problem in biology," SIAM Journal of Applied Mathematics, 48:1073-1082, (1988).
Carmichael et al., "Rodent models of focal stroke: size, mechanism, and purpose," NeuroRx 2:396-409 (2005).
Chang et al., "Changing residue 338 in human factor IX from arginine to alanine causes an increase in catalytic activity," Journal of Biological Chemistry 273(20): 12089-12094 (1998).
Chang et al., "Replacing the first epidermal growth factor like domain of factor VII enhances clotting activity," Journal of Thrombosis and Haemostasis Abst 73:1202 (1995).
Chen et al., "A model of focal ischemic stroke in the rat: reproducible extensive cortical infarction," Stroke 17:738-743 (1986).
Chen et al., "Three point mutations in the factor IX genes of five hemophilia B patients. Identification strategy using localization by altered epitopes in their hemophilic proteins," Journal of Clinical Investigation 84(1):113-118 (1989).
Cheung et al., "Identification of the endothelial cell binding site for factor IX," Proceedings of the National Academy of Sciences of the United States of America 93:11068-11073 (1996).
Cheung et al., "The binding of human factor IX to endothelial cells is mediated by residues 3-11," Journal of Biological Chemistry 267(29):20529-20531 (1992).
Cheung et al., "The role of the epidermal growth factor-1 and hydrophobic stack domains of human factor IX in binding to endothelial cells," Journal of Biological Chemistry 266(14):8797-8800 (1991).
Chu et al., "A mutation in the propeptide of factor IX leads to warfarin sensitivity be a novel mechanism" Journal of Clinical Investigation 98:1619-1625 (1996).
Cott et al., "Haemophilic factors produced by transgenic livestock:abundance that can enable alternative therapies worldwide," Papers in Biotechnology 1-21 (2004).
Cummings, R., "Use of lectins in analysis of glycoconjugates," Methods in Enzymology, 230:66-86, (1994).
Cuzner, M. and G. Opdenakker, "Plasminogen activators and matrix metalloproteases, mediators of extracellular proteolysis in inflammatory demyelination of the central nervous system," Journal of Neuroimmunology 94(1-2):1-14 (1999).
David et al., "Single-strand conformation polymorphism (SSCP) analysis of the molecularpathology of hemophilia," Human Mutation 2(5):355-361 (1993).
Dayhoff, et al., "A model of evolutionary change in proteins," Atlas of Protein Sequence and Structure, 5(3): 345-352, (1978).
de la Salle et al., "The Arg-4 mutant factor IX Strasbourg 2 shows a delayed activation by factor Xia," Nouvelle Revue Francaise d'Hématologie 35(5):473-480 (1993).
Devereux, et al., "A comprehensive set of sequence analysis programs for the VAX," Nucleic Acids Research, 12(I):387-399, (1984).
Diuguid et al., "Molecular defects of factor IX Chicago-2 (Arg 145—His) and prothrombin Madrid (Arg 271—cys): arginine mutations that preclude zymogen activation," Blood 74(1):193-200 (1989).
Diuguid et al., "Molecular basis of hemophilia B: a defective enzyme due to an unprocessed propeptide is caused by a point mutation in the factor IX precursor," Proceedings of the National Academy of Sciences of the United States of America 83(16):5803-5807 (1986).
Dodds, W., "Animal models for the evolution of thrombotic disease," Annals of the NewYork Academy of Sciences 516:631-635 (1987).
Evans et al., Proceedings of the National Academy of Sciences of the United States of America 86:10095 (1989).

Feng et al., "Aligning amino acid sequences: comparison of commonly used methods," Journal of Molecular Evolution 21:112-125 (1985).

Fitch, W., "An improved method of testing for evolutionary homology," Journal of Molecular Evolution, 16(1):9-16, (1966).

Franchini et al., "Recombinant factor VIIa. An update on its clinical use," Journal of Thrombosis and Haemostasis 93(6): 1027-1035 (2005).

Friedler, A., et al., "Development of a functional backbone cyclic mimetic of the HIV-1 Tat arginine-rich motif," Journal of Biological Chemistry, 275:23783-23789, (2000).

Furie, B. and B. Furie, "The molecular basis of blood coagulation," Cell 53:505-518 (1988).

Galeffi, P. and G. Brownlee, "The propeptide region of clotting factor IX is a signal for a vitamin K dependent carboxylase: evidence from protein engineering of amino acid-4," Nucleic Acids Research 15(22):9505-9513 (1987).

Gerriets et al., "The macrosphere model:evaluation of a new stroke model for permanent middle cerebral artery occlusion in rats," Journal of Neuroscience Methods 122: 201-211 (2003).

Gianelli et al., "Haemophilia B: database of point mutations and short additions and deletions" Nucleic Acids Research 26:265-268 (1998).

Gonnet et al., "Exhaustive matching of the entire protein sequence database," Science, 256:1433-1445, (1992).

Grantham, R., "Amino acid difference formula to help explain protein evolution," Science, 185:862-864, (1974).

Green et al., "(Introduction to) The Haemophilia B Mutation Database—version 13" http://www.kcl.ac.uk/ip/petergreen/intro.html (2 pgs.) (accessed on Nov. 20, 2007).

Grenier, D. and D. Mayrand, "Selected characteristics of pathogenic and nonpathogenic strains of Bacteroides gingivalis," Journal of Clinical Microbiology, 25:738-740 (1987).

Gribskov, M. and R. Burgess, "Sigma factors from E. coli, B. subtilis, phage SP01, and phage T4 are homologous proteins," Nucleic Acids Research, 14:6745-6763, (1986).

Gui et al., "Circulating and binding characteristics of wild-type factor IX and certain Gla domain mutants in vivo," Blood 100(1):153-158 (2002).

Hamaguchi et al., "Mutations in the catalytic domain of factor IX that are related to the subclasshemophilia Bm.Biochemistry," 32(25):6324-6329 (1993).

Hanisch et al., "Evidence for glycosylation-dependent activities of polypeptide N-acetylgalactosaminyltransferases rGalNAc-T2 and—T4 on mucin glycopeptide," Glycobiology, 11:731-740, (2001).

Harrison et al., "The manufacturing process for recombinant factor IX," Seminars in Hematology 35(Suppl. 2):4-10 (1998).

Hassan et al., "Intragenic Factor IX restriction site polymorphism in hemophilia B variants," Blood 65(2):441-443 (1985).

Henikoff, S. and J. Henikoff, "Amino acid substitution matrices from protein blocks," Proceedings of the National Academy of Sciences of the United States of America, 89:10915-10919, (1992).

Herzog et al., "Immune implications of gene therapy for hemophilia," Seminars in Thrombosis and Hemostasis 30(2):215-226 (2004).

Hopfner et al., "Converting blood coagulation factor IXa into factor Xa: dramatic increase in amidolytic activity identifies important active site determinants," The EMBO Journal 16:6626-6635 (1997).

Hsu et al., "The distinct roles that Gln-192 and Glu-217 of factor IX play in selectivity for macromolecular substrates and inhibitors," Biochemistry 40:11261-11269 (2001).

http://bioinfo.hku.hk/services/analyseq/cgi-bin/proteol_in.pl (2 pgs.) (accessed on Nov. 21, 2007).

http://www.biochem.ucl.ac.uk/~becky/SP/index.php, "Serine protease mutation database," (1 pg.) (accessed on Jan. 8, 2008).

http://www.emedicine.com/med/topic364.htm, Schwartz et al., "Factor IX," (32 pgs.) (accessed on Nov. 20, 2007).

http://www.hemophilia.org/NHFWeb/MainPgs/MainNHF.aspx?menuid=118&contentid=122, University of Nebraska-Lincoln news release, "University of Nebraska Receives NIH Grant for New Hemophilia B Treatment," (2 pgs.) (accessed on Nov. 20, 2007).

http://www.kcl.ac.uk/ip/petergreen/haemBdatabase.html, Haemophilia B Mutation Database Version 13, King's College London (2004) (2 pgs.) (accessed on Jan. 7, 2008).

http://www.mogam.re.kr/eng/nage/he01.asp, "Recombinant Factor IX," (2 pgs.) (accessed on Nov. 20, 2007).

http://www.oncolink.com/custom_tags/print_article.cfrn?Page=2&id=11748&Section=Reuters Articles, Harding A., "Mutations boost bioavailability of factor IX gene therapy," (2 pgs.) (accessed on Nov. 20, 2007).

http://www.rxlist.com/cgi/generic/factorix_cp.htm, "Benefix clinical phramacology," (3 pgs.) (accessed on Nov. 20, 2007).

http://www.rxlist.com/cgi/generic/factorix_ids.htm, "Benefix indications and dosage," (5 pgs.) (accessed on Nov. 20, 2007).

http://www.wyeth.com.au/go/news/wyeth-builds-on-commitment-to-innovation-in-haemophilia , "Wyeth Builds Commitment to Innovation in Haemophilia," (2pgs.) (accessed on Nov. 20, 2007).

Huang et al., "Molecular defect in factor IXHilo, a hemophilia Bm variant: Arg—Gln at the carboxyterminal cleavage site of the activation peptide," Blood 73(3):718-721 (1989).

Hughes et al., "Protein engineering of the hydrophobic domain of human factor IX," Protein Engineering 7(9):1121-1127 (1994).

IUPAC-IUB, "Abbreviated nomenclature of synthetic poypeptides-polymerized amino acids-revised recommendations," Commission on Biochemical Nomenclature, Biochemistry 11:942-944 (1972).

IUPAC-IUB, "Abbreviated nomenclature of synthetic poypeptides-polymerized amino acids-revised recommendations," Commission on Biochemical Nomenclature, Biochemistry 11:1726-1731 (1972).

Jenny et al., "Purification of six human vitamin K-dependent proteins in a single chromatographic step using immunoaffinity columns," Preparative Biochemistry 16:227-245 (1986).

Jin et al., "Creation of a mouse expressing defective human factor IX," Blood 104:1733-1739 (2004).

Johnson, M. and J. Overington, "A structural basis for sequence comparisons-an evaluation of scoring methodologies," Journal of Molecular Biology 233:716-738 (1993).

Jones, et al., "The rapid generation of mutation data matrices from protein sequences," Computer Applications in the Biosciences 8:275-282 (1992).

Kagawa, Y., et al., "Comparative study of the asparagine-linked sugar chains of natural human interferon-beta 1 and recombinant human interferon-beta 1 produced by three different mammalian cells," Journal of Biological Chemistry, 263:17508-17515, (1988).

Kaufman et al., "Expression, purification, and characterization of recombinant gamma-carboxylated factor IX synthesized in Chinese hamster ovary cells ," Journal of Biological Chemistry 261:9622-9628 (1986).

Kaufman et al., "Post-translational modifications required for coagulation factor secretion and function ," Journal of Thrombosis and Haemostasis 79:1068-1079 (1998).

Kay et al., "In vivo hepatic gene therapy: complete albeit transient correction of factor IX deficiency in hemophilia B dogs," Proceedings of the National Academy of Sciences of the United States of America 91:2353-2357 (1994).

Keith et al. "Evaluation of recombinant human factor IX: pharmacokinetic studies in the rat and the dog," Journal of Thrombosis and Haemostasis 73(1): 101-105 (1995).

Ketner, G., et al., "Efficient manipulation of the human adenovirus genome as an infectious yeast artificial chromosome clone," Proceedings of the National Academy of Sciences of the United States of America, 91:6186-6190, (1994).

Khalizzadeh, R., et al., "Process development for production of recombinant human interferon-γ expressed in escherichia coli," Journal of Industrial Microbiology and Biotechnology, 31(2):63-69, (2004).

King, M., "Blood coagulation," www.med.unibs.it/~marchesi/blood.html (16 pgs.) (accessed on Nov. 20, 2007

Kisiel et al., "Proteolytic inactivation of blood coagulation factor IX by thrombin," Blood 66(6):1302-1308 (1985).

Knobe et al., "Functional analysis of the EGF-like domain mutations Pro55Ser and Pro55Leu, which cause mild hemophilia B," Journal of Thrombosis and Haemostasis 1:782-790 (2003).

Koizumi et al., "Experimental studies of ischemic brain edema 1. a new experimental model of cerebral embolism in rats in which recirculation can be introduced in the ischemic area," Japanese Journal of Stroke 8:1-8 (1986) [article in Japanese with English language abstract].

Kolkman et al., "Regions 301-303 and 333-339 in the catalytic domain of blood coagulation factor IX are factor VIII-interactive sites involved in stimulation of enzyme activity," Biochemistry Journal 339:217-221 (1999).

Kolkman et al., "Regions 301-303 and 333-339 in the catalytic domain of blood coagulation factorIX are factor VIII-interactive sites involved in stimulation of enzyme activity," Biochemistry Journal 339 ( Pt 2):217-221 (1999).

Kolkman, J. and K. Mertens, "Surface-loop residue Lys316 in blood coagulation Factor IX is a major determinant for Factor X but not antithrombin recognition," Biochemistry Journal 350:701-707 (2000).

Kundu et al., "Targeted inactivation of the coagulation factor IX gene causes hemophilia B in mice," Blood 92:168-174 (1998).

Kurachi et al., "Regulatory mechanism of human factor IX gene:protein binding at the Leyden-specific region" Biochemistry 34(43):14270 (1995).

Kurachi et al., "The carboxyl-terminal region of factor IX is essential for its secretion," Biochemistry A36(14):4337-4344 (1997).

Lavigne et al., "Thrombophilic families with inheritably associated high levels of coagulation factors VIII, IX and XI," Journal of Thrombosis and Haemostasis 1:2134-2130 (2003).

Leibman et al., "Immunoaffinity purification of Factor IX (Christmas Factor) by using conformation-specific antibodies directed against the Factor IX-Metal Complex," Proceedings of the National Academy of Sciences of the United States of America 82:3879-3883 (1985).

Leppert, et al., "Matrix metalloproteinases: multifunctional effectors of inflammation in multiple sclerosis and bacterial meningitis," Brain Research and Brain Research Reviews, 36(2-3):249-257, (2001).

Liddell et al., "Defective propeptide processing and abnormal activation underlie the molecular pathology of factor IX Troed-y-Rhiw," British Journal of Haematology 72:208-215 (1989).

Lin et al. "Expression and characterization of human factor IX and factor IX-factor X chimeras in mouse C127 cells," Journal of Biological Chemistry 265(1):144-150 (1990).

Lin et al., "A coagulation factor IX-deficient mouse model for human hemophilia B," Blood 90:3962-3966 (1997).

Lin, S. and M. Shen, "Characterization of genetic defects of hemophilia B of Chinese origin," Thrombosis and Haemostasis 66(4):459-463 (1991).

Lin et al., "Genetic basis and carrier detection of hemophilia B of Chinese origin," Thrombosis and Haemostasis 69(3):247-252 (1993).

Lindenbaum, M., et al., "A mammalian artificial chromosome engineering system (ACE System) applicable to biopharmaceutical protein production, transgenesis and gene-based cell therapy," Nucleic Acids Research, 32(21):e172, (2004).

Longa et al., "Reversible middle cerebral artery occlusion without craniectomy in rats," Stroke 20:84-91 (1989).

Lozier et al. "The rhesus macaque as an animal model for hemophilia B gene therapy," Blood 93(6):1875-1881 (1999).

Ludwig et al., "Hemophilia B caused by five different nondeletion mutations in the protease domain of factor IX," Blood 79(5):1225-1232 (1992).

Mahajan et al., Indian Genome Variation Consortium, "Allelic heterogeneity of molecular events in human coagulation factor IX in AsianIndians," Mutation in brief #965, Online Human Mutation 28(5):52 (2007).

Marsh et al., "Ultrastructure and enzyme activities of a virulent and an avirulent variant of Bacteroides gingivalis W50," FEMS Microbiology Letters 59:181-185 (1989).

Martin, P., "Beyond the next generation of therapeutic proteins," Online Article Oct. 2006, http://www.biotech-online.com/artimg/a20062123243425.PDF (accessed on Jan. 11, 2007) (3 pages).

Martin, P., "Next Generation Products and Prospects for the Oral Delivery of Proteins" (Meeting Abstract) Fourth Annual Protein Process Development (Jan. 11, 2007) http://www.chi-peptalk.com/06_Ppd.asp (2 pgs.) (accessed Mar. 20, 2007).

Martin, P., "The Market for Therapeutic Proteins: New Business Opportunities" (Meeting Abstract) Second Annual Advancing Protein Therapeutics, Engineering the Next Generation of Proteins for Therapeutics (Jan. 13, 2006) http://www.chi-peptalk.com/pttn2006.asp (2 pgs.) (accessed Mar. 19, 2007).

Mathur, A. and S. Bajaj "Protease and EGF1 domains of factor IXa play distinct roles in binding to factor VIIIa. Importance of helix 330 (helix 162 in chymotrypsin) of protease domain of factor IXa in its interaction with factor VIIIa," Journal of Biological Chemistry 274(26):18477-18486 (1999).

Mauser et al., "A deletion mutation causes hemophilia B in Lhasa Apso dogs," Blood 88:3451-3455 (1996).

Mayfield, et al., "Expreession and assembly of a fully active antibody in algae," Proceedings of the National Academy of Sciences of the United States of America, 100:438-442 (2003).

Mayhew et al., "Ligand requirements for Ca2+ binding to EGF-like domains," Protein Engineering 5(6):489-494 (1992).

Mayzel-Oreg et al., "Microsphere-induced embolic stroke: an MRI study," Magnetic Resonance in Medicine 51:1232-1238 (2004).

McGraw et al., "Structure and function of factor IX: defects in haemophilia B," Clinics in Haematology 14:359-383 (1985).

McGuire, et al., "Interaction of Huntingtin-associated protein-1 with kinesin light change," Journal of Biological Chemistry, 243: 3552-3559, (1969).

McLachlan, A., "Tests for comparing related amino-acid sequences. Cytochrome c and cytochrome c 551," Journal of Molecular Biology, 61:409-424, (1971).

Media Release: "Nautilus Biotech: 'Next Generation Biopharmaceuticals (NGB)'" Paris, France Jun. 21, 2004 ://www.prnewswire.co.uk/cgi/news/release?id=125241 (accessed on Jan. 8, 2007) (1 page).

Media Release: "Wyeth Pharmaceuticals and Nautilus Biotech Announce Collaboration to Develop Hemophilia Therapies." Paris, France Feb. 5, 2007 http://www.nautilusbiotech.com/news_050207.html (accessed on Jul. 9, 2007) (2 pages).

Meulien et al. "Increased biological activity of a recombinant factor IX variant carrying alanine at position +1," Protein Engineering 3(7):629-633 (1990).

Miyata et al., "Factor IX Amagasaki: a new mutation in the catalytic domain resulting in the loss of both coagulant and esterase activities," Biochemistry 30:11286-11291 (1991).

Miyata, T., "Two types of amino acid substitutions in protein evolution," Journal of Molecular Evolution, 12:219-236, (1979).

Monroe et al., "Functional consequences of an arginine180 to glutamine mutation in factor IX Hilo," Blood 3(6):1540-1544 (1989).

Mukherjee et al., "Analysis of haemophilia B database and strategies for identification of commonpoint mutations in the factor IX gene," Haemophilia 9(2):187-192 (2003).

Muneta, et al., "Large-scale production of porcine mature interleukin-18 (IL-18) in silkworms using a hybrid baculovirus expression system," Journal of Veterinary Medical Science, 65(2):219-223, (2003).

Nanji et al., "Animal models of alcoholic liver disease—focus on the intragastric feeding model," Alcohol Research and Health 27(4):325-330 (2003).

Needleman, S. and C. Wunsch, "A general method applicable to the search for similarities in the amino acid sequence of two proteins," Journal of Molecular Biology, 48:443-453, (1970).

Opdenakker, G., "On the roles of extracellular matrix remodeling by gelatinase," B Verh. K. Acad. Geneeskd. Belg. 59(6): 489-514 (1997).

Palmer et al., "Production of human factor IX in animals by genetically modified skin fibroblasts:potential therapy for hemophilia B," Blood 73:438-445 (1989).

Pearson, W. and D. Lipman , "Improved tools for biological sequence comparison," Proceedings of the National Academy of Sciences of the United States of America, 85:2444-2448, (1988).

Perera et al., "Modeling human zymogen factor IX," Thrombosis and Haemostasis 85(4):596-603 (2001).

Pham, P., et al., "Large-scale transient transfection of serum-free suspension-growing HEK293 EBNA1 cells: peptone additives improve cell growth and transfection efficiency," Biotechnology and Bioengineering, 84:332-342, (2003).

Pipe et al., "New high technology products for the treatment of haemophilia," Haemophilia 10:55-63 (2004).

Pipe, S., "The promise and challenges of bioengineered recombinant clotting factors," Journal of Thrombosis and Haemostasis 3(8):1692-1701 (2005).

Platis, D. and G. Foster, "High yield expression, refolding, and characterization of recombinant interferon alpha2/alpha8 hybrids in *Escherichia coli*," Protein Expression and Purification 31(2):222-230 (2003).

Poon et al., "Hemophilia B carrier determination based on family-specific mutation detection byDNA single-strand conformation analysis," Journal of Laboratory and Clinical Medicine 122(1):55-63 (1993).

Potempa et al., Journal of Biological Chemistry 273:21648-21657 (1998).

Proctor, R. and S. Rapaport, "The partial thromboplastin time with kaolin," American Journal of Clinical Pathology 36:212 (1961).

Przysiecki et al., "Occurrence of β-hydroxylated asparagine residues in non-vitamin K-dependent proteins containing epidermal growth factor-like domains," Proceedings of the National Academy of Sciences of the United States of America 84:7856-7860 (1987).

Rabiet et al., "Effect of propeptide mutations on post-translational processing of factor IX," Journal of Biological Chemistry 262:14895-14898 (1987).

Rao, J., "New scoring matrix for amino acid residue exchanges based on residue characteristic physical parameters," International Journal of Peptide and Protein Research 29:276-281 (1987).

Risler, J., et al., "Amino acid substitutions in structurally related proteins A pattern recognition approach," Journal of Molecular Biology, 204:1019-1029, (1988).

Rohlena et al., "Residues Phe342-Asn346 of activated coagulation factor IX contribute to the interaction with low density lipoprotein receptor-related protein," Journal of Biological Chemistry 278:9394-9401 (2003).

Roth et al., "Human recombinant factor IX: safety and efficacy studies in hemophilia B patients previously treated with plasma-derived factor IX concentrates," Blood 98(13): 3600-3606 (2001).

Sabatino et al., "Novel hemophilia B mouse models exhibiting a range of mutations in the factor IX gene," Blood 104(9): 2767-2774 (2004).

Saenko et al., "The future of recombinant coagulation factors," Journal of Thrombosis and Haemostasis 1(5):922-930, (2003).

Samis et al. "Proteolytic processing of human coagulation factor IX by plasmin," Blood 95(3):943-951 (2000).

Samis et al., "Neutrophil elastase cleavage of human coagulation factor IX generates an activated factor IX-like product devoid of coagulant function," Blood 92(4):1287-1296 (1998).

Schuettrumpf et al., "Factor IX variants improve gene therapy efficacy for hemophilia B," Blood 105(6): 2316-2323 (2005).

Schulman et al., "Efficacy of a high purity, chemically treated and nanofiltered factor IX concentrate for continuous infusion in haemophilia patients undergoing surgery," Haemophilia 5(2):96-100 (1999).

Schwartz and Dayhoff, eds., *Atlas of Protein Sequence and Structure*, National Biomedical Research Foundation, pp. 353-358 (1979).

Shapiro et al., "The safety and efficacy of recombinant human blood coagulation factor IX in previously untreated patients with severe or moderately severe hemophilia B," Blood 105(2): 518-525 (2005).

Sheffield et al., "Effects of genetic fusion of Factor IX to albumin on in vivo clearance in mice and rabbits," British Journal of Haematology 126(4): 565-573 (2004).

Sichler et al., "Physiological fIXa activation involves a cooperative conformational rearrangement of the 99-loop," Journal of Biological Chemistry 278(6):4121-4126 (2003).

Skoko et al., "Expression and characterization of human interferon-betal in the methylotrophic yeast *Pichia pastoris*," Biotechnology and Applied Biochemistry 38(Pt3):257-265 (2003).

Smalley et al., "The distribution of trypsin-like enzyme activity in cultures of a virulent and an avirulent strain of Bacteroides gingivalis W50," Oral Microbiology and Immunology 4:178-181 (1989).

Smith et al., "Single-step purification of polypeptides expressed in *Escherichia coli* as fusions with glutathione S-transferase," Gene 67:31-40 (1988).

Smith, K., "Immunoaffinity purification of factor IX from commercial concentrates and infusion studies in animals," Blood, 72,1269-1277 (1988).

Smith, T. and M. Waterman, "Comparison of biosequences," Advances in Applied Mathematics 2:482-489 (1981).

Solera et al., "Identification of a new haemophilia BM case produced by a mutation located at the carboxy terminal cleavage site of activation peptide," British Journal of Haematology 78(3):385-389 (1991).

Soriano-Garcia et al., "The Ca2+ ion and membrane binding structure of the Gla domain of Ca-prothrombin fragment 1," Biochemistry 31:2554-2566 (1992).

Spitzer et al., "Replacement of isoleucine-397 by threonine in the clotting proteinase factor IXa (Los Angeles and Long Beach variants) affects macromolecular catalysis but not L-tosylarginine methylester hydrolysis. Lack of correlation between the ox brain prothrombin time and the mutation site in the variant proteins," Biochemistry Journal 265:219-25 (1990).

Srour et al., "Regulation of human factor IX expression using doxycycline-inducible gene expression system," Journal of Thrombosis and Haemostasis 90(3): 398-405 (2003).

Stenflo, J., "Structure-function relationships of epidermal growth factor modules in vitamin K-dependent clotting factors," Blood 78(7):1637-1651 (1991).

St-Pierre et al., "Emerging features in the regulation of MMP-9 gene expression for the development of novel molecular targets and therapeutic strategies," Current Drug Targets Inflammation and Allergy 2(3):206-215 (2003).

Sturzebecher et al., "Dramatic enhancement of the catalytic activity of coagulation factor IXa by alcohols," FEBS Letters (412) 295-300 (1997).

Suehiro et al., "Blood clotting factor IX BM Nagoya. Substitution of arginine 180 by tryptophan and its activation by alpha-chymotrypsin and rat mast cell chymase," Journal of Biological Chemistry 264(35):21257-21265 (1989).

Suehiro et al., "Blood clotting factor IX Nagoya 3: the molecular defect of zymogen activation caused by an arginine-145 to histidine substitution," Thrombosis Research 60(4):311-320 (1990).

Sugimoto et al., "Factor IX Kawachinagano: impaired function of the Gla-domain caused by attached propeptide region due to substitution of arginine by glutamine at position-4," British Journal of Haematology 72(2):216-221 (1989).

Takaki et al., "Cleavage and inactivation of factor IX by granulocyte elastase," Journal of Clinical Investigation 72:1706-1715 (1983).

Tamura, et al., "Focal cerebral ischaemia in the rat:1.Description of technique and early neuropathological consequences following middle cerebral artery occlusion," Journal of Cerebral Blood Flow and Metabolism 1:53-60 (1981).

Taylor et al., "A mutation adjacent to the beta cleavage site of factor IX (valine 182 to leucine) results in mild haemophilia BM," British Journal of Haematology 75(2):217-221 (1990).

Ten Hagen et al., "All in the family: the UDP-GalNAc:polypeptide N-acetylgalactosaminyltransferases," Glycobiology, 13:1R-16R, (2003).

Ten Hagen et al., "All in the family: the UDP-GalNAc:polypeptide N-acetylgalactosaminyltransferases," Journal of Biological Chemistry, 274:27867-27874, (1999).

Thomson, A. and S. Kapadia, "The specificity of the S1 and S2 subsites of elastase," European Journal of Biochemistry 102:111-116 (1979).

UniprotKB/Swiss Prot No. P00740 (25 pgs.) (accessed on Nov. 12, 2007).

Usharani et al., "Characterization of three abnormal factor IX variants (Bm Lake Elsinore, Long Beach, and Los Angeles) of hemophilia-B. Evidence for defects affecting the latest catalytic site," Journal of Clinical Investigation 75:76-83 (1985).

Vega, M., "Improving the delivery and pharmakokinetics of therapeutic proteins by increased resistance to proteolysis," (Meeting Abstract) Second Annual Advancing Protein Therapeutics, Engineering the Next Generation of Proteins for Therapeutics, (Jan. 12, 2006) http://www.chi-peptalk.com/pttn2006.asp (2 pgs.) (accessed on Mar. 19, 2007).

Vega, M., "Next-Generation Protein Therapeutics for Oral Delivery," (Meeting Abstract) Third Annual Optimizing Protein and Antibody Therapeutics, Pioneering New Frontiers, (Jan. 9, 2007) http://www.chi-peptalk.com/06_PTT.asp (2 pgs.) (accessed on Mar. 19, 2007).

Wacey et al., "Determinants of the factor IX mutational spectrum in haemophilia B: an analysis of missense mutations using a multi-domain molecular model of the activated protein" Hum Genet 94:594-608 (1994).

Wajih et al., "Increased production of functional recombinant human clotting factor IX by baby hamster kidney cells engineered to overexpress VKORC1, the vitamin K 2,3-Epoxide-reducing enzyme of the vitamin K cycle," Journal of Biological Chemisty 280(36):31603-31607 (2005).

Wang et al., "A factor IX-deficient mouse model for hemophilia B gene therapy," Proceedings of the National Academy of Sciences of the United States of America 94:11563-11566 (1997).

Wang et al., "Factor IX Chongqing: a new mutation in the calcium-binding domain of factor IX resulting in severe hemophilia B," Thrombosis and Haemostasis 63(1):24-26 (1990).

Wang et al., "Point mutations in four hemophilia B patients from China," Factor IX Chongqing: a new mutation in the calcium-binding domain of factor IX resulting in severe hemophilia B, Thrombosis and Haemostasis 64(2):302-306 (1990).

Ware et al., "Factor IX San Dimas. Substitution of glutamine for Arg-4 in the propeptide leads to incomplete gamma-carboxylation and altered phospholipid binding properties," Journal of Biological Chemistry 264(19):11401-11406 (1989).

Wasley et al., "PACE/furin can process the vitamin K-dependent pro-factor IX precursor within the secretory pathway," Journal of Biological Chemistry 268(12):8458-8465 (1993).

Watson et al., "Induction of reproducible brain infarction by photochemically initiated thrombosis," Annals of Neurology 17:497-504 (1985).

Weinberg, M. and M. Bral, "Laboratory animal models in periodontology ," Journal of Periodontology 26(6):335-340 (1999).

Weiner, A., "Liposome-collagen gel matrix: a novel sustained drug delivery system," Journal of Pharmaceutical Sciences, 74(9):922-925, (1985).

Weltermann et al., "The risk of recurrent venous thromboembolism among patients with high factor IX levels" Journal of Thrombosis and Haemostasis 1(1):28-32 (2003); Comment in Journal of Thrombosis and Haemostasis 1(1):16-18 (2003).

White et al., "Recombinant factor IX," Journal of Thrombosis and Haemostasis 78(1):261-265 (1997).

Whiteman et al., "A Gly→ Ser change causes defective folding in vitro of calcium-binding epidermal growth factor-like domains from factor IX and fibrillin-1," Journal of Biological Chemistry 273:7807-7813 (1998).

Wilkinson et al., "The Factor IXa second epidermal growth factor (EGF2) domain mediates platelet binding and assembly of the factor X activating complex," Journal of Biological Chemistry 277(8):5734-5741 (2002).

Winship et al., "Identification of haemophilia B patients with mutations in the two calcium binding domains of factor IX: importance of a beta-OH Asp 64—Asn change," British Journal of Haematology 77(1):102-109 (1991).

Wojcik et al., "Modification of the N-terminus of human factor IX by defective propeptide cleavage or acetylation results in a destabilized calcium-induced conformation:effects on phospholipid binding and activation by factor Xia," Biochemistry Journal 323:629-36 (1997).

Wojcik et al., "Mutations which introduce free cysteine residues in the Gla-domain of vitamin K dependent proteins result in the formation of complexes with alpha 1 microglobulin," Journal of Thrombosis and Haemostasis 75:70-75 (1996).

Wu et al., "Hemophilia B with mutations at glycine-48 of factor IX exhibited delayed activation by the factor VIIa-tissue factor complex," Journal of Thrombosis and Haemostasis 84:626-34 (2000).

Yamauchi et al., "A murine model of acute liver injury induced by human monoclonal autoantibody," Hepatology 42(1):149-155 (2005).

Yao et al., "Expression of human factor IX in mice after injection of genetically modified myoblasts," Proceedings of the National Academy of Sciences of the United States of America 89:3357-3361 (1992).

Yao et al., "Expression of human factor IX in rat capillary endothelial cells: toward somatic gene therapy for hemophilia B," Proceedings of the National Academy of Sciences of the United States of America 88:8101-8105 (1991).

Zhang et al., "A new rat model of thrombotic focal cerebral ischemia," Journal of Cerebral Blood Flow and Metabolism 17:123-135 (1997).

Zhang et al., "Transgene expression levels and kinetics determine risk of humoral immuneresponse modeled in factor IX knockout and missense mutant mice," Gene Therapy 14(5):429-440 (2007).

Zhong et al., "First epidermal growth factor-like domain of human blood coagulation factor IX is required for its activation by factor VIIa/ tissue factor but not by factor Xia," Proceedings of the National Academy of Sciences of the United States of America 91:3574-3578 (1994).

Begbie et al., "An important role for the activation peptide domain in controlling factor IX levels in the blood of haemophilia B mice," *Thrombosis and Haemostasis* 94:1138-1147 (2005).

Chang et al., "Identification of functionally important residues of the epidermal growth factor-2 domain of factor IX by alanine-scanning mutagenesis. Resides Asn(89)-Gly(93) are critical for binding factor VIIIa," *J Biol Chem* 277:25393-25399 (2002).

Hertzberg et al., "An Arg/Ser substitution in the second epidermal growth factor-like module of factor IX introduces an O-linked carbohydrate and markedly impairs activation by factor Xia and factor VIIIa/Tissue factor and catalytic efficiency of factor IXa," *Blood* 94:156-163 (1999).

International Search Report, issued Jun. 13, 2008 in connection with corresponding International Application No. PCT/US2007/014219.

U.S. Appl. No. 11/704,141, filed Feb. 7, 2007.
U.S. Appl. No. 11/788,836, filed Apr. 19, 2007.
U.S. Appl. No. 11/825,604, filed Jul. 5, 2007.
U.S. Appl. No. 11/998,387, filed Nov. 28, 2007.
U.S. Appl. No. 12/082,365, filed Apr. 9, 2008.
U.S. Appl. No. 12/082,389, filed Apr. 9, 2008.
U.S. Appl. No. 12/157,150, filed Jun. 6, 2008.

European Examination Report, issued Oct. 22, 2010, in connection with European Patent Application No. 07 809 648.4.

Translation of Chilean Office Action, issued Nov. 30, 2010, in connection with Chilean Patent Application No. 1796-2007.

International Patent Publication No. WO 2002/40544, published May 23, 2002.

U.S. Appl. No. 11/656,921, filed Jan. 22, 2007.
U.S. Appl. No. 11/703,610, filed Feb. 6, 2007.
U.S. Appl. No. 11/704,141, filed Feb. 7, 2007
U.S. Appl. No. 11/729,267, filed Mar. 27, 2007.
U.S. Appl. No. 11/729,266, filed Mar. 27, 2007.
U.S. Appl. No. 11/825,604, filed Jul. 5, 2007

Melton et al., "Location of the platelet binding site in zymogen coagulation factor IX," Blood Coagul. Fibrin. 12(4):237-243 (2001).

Yang et al., "Contribution of basic residues of the autolysis loop to the substrate and inhibitor specificity of factor IXa," J. Biol. Chem. 278(27):25032-25038 (2003).

BioWorld Today, "Other News to Note," BioWorld Today 21(243):2 (2010).

Response to Examination Report, submitted Apr. 28, 2011, in connection with corresponding European Patent Application No. 07809648.4, 10 pages.

Response to Official Action, submitted May 25, 2011, in connection with corresponding Chilean Patent Application no. 1796-2007, 4 pages.

U.S. Appl. No. 13/373,118, filed Nov. 3, 2011.

Chang et al., "Discontinuous residues of factor IX constitute a surface for binding the anti-factor IX monoclonal antibody A-5," Thromb. Res. 111(4-5):293-299 (2003).

Hamaguchi et al., "The role of amino-terminal residues of the heavy chain of factor IXa in the binding of its cofactor, factor VIIIa," Blood 84(6):1837-1842 (1994).

Examination Report, issued Nov. 7, 2011, in connection with corresponding European Patent Application No. 07809648.4, 4 pages Official Action, issued Nov. 11, 2011, in connection with corresponding Chilean Patent Application No. 1796-2007, 3 pages.

Instructions for Response, filed Jan. 10, 2012, in connection with corresponding Chilean Patent Application No. 1796-2007, 43 pages.

Instructions for Response, filed Jan. 18, 2012, in connection with corresponding Argentinian Patent Application No. 07 01 02694, 38 pages.

Extended European Search Report, issued Jan. 30, 2012, in connection with corresponding European Patent Application No. 11189828.4, 7 pages.

Extended European Search Report, issued Jan. 30, 2012, in connection with corresponding European Patent Application No. 11189834.2, 7 pages.

Extended European Search Report, issued Jan. 30, 2012, in connection with corresponding European Patent Application No. 11189837.5, 7 pages.

* cited by examiner

US 8,383,388 B2

MODIFIED COAGULATION FACTOR IX POLYPEPTIDES AND USE THEREOF FOR TREATMENT

RELATED APPLICATIONS

Benefit of priority is claimed to U.S. Provisional Application Ser. No. 60/815,113, to Jorge Oyhenart, Xavier Gallet, Gilles Borelly, Thierry Guyon, Lila Drittanti and Manuel Vega, entitled "MODIFIED COAGULATION FACTOR IX POLYPEPTIDES AND USE THEREOF FOR TREATMENT," filed Jun. 19, 2006. This application is related to International PCT application No. PCT/US2007/14219, entitled "MODIFIED COAGULATION FACTOR IX POLYPEPTIDES AND USE THEREOF FOR TREATMENT," to Nautilus Biotech, Jorge Oyhenart, Xavier Gallet, Gilles Borelly, Thierry Guyon, Lila Drittanti and Manuel Vega, which also claims priority to U.S. Provisional Application Ser. No. 60/815,113. The subject matter of each of these applications is incorporated by reference in its entirety.

This application is related to U.S. application Ser. No. 11/176,830, to Rene Gantier, Thierry Guyon, Manuel Vega and Lila Drittanti, entitled "RATIONAL EVOLUTION OF CYTOKINES FOR HIGHER STABILITY, THE CYTOKINES AND ENCODING NUCLEIC ACID MOLECULES," filed Jul. 6, 2005 and published as U.S. Application No. US 2006-0020116, which is a continuation of U.S. application Ser. No. 10/658,834, to Rene Gantier, Thierry Guyon, Manuel Vega and Lila Drittanti entitled "RATIONAL EVOLUTION OF CYTOKINES FOR HIGHER STABILITY, THE CYTOKINES AND ENCODING NUCLEIC ACID MOLECULES," filed Sep. 8, 2003 and published as U.S. Application No. US-2004-0132977-A1. This application also is related to U.S. application Ser. No. 11/196,067, to Rene Gantier, Thierry Guyon, Hugo Cruz Ramos, Manuel Vega and Lila Drittanti entitled "RATIONAL DIRECTED PROTEIN EVOLUTION USING TWO-DIMENSIONAL RATIONAL MUTAGENESIS SCANNING," filed Aug. 2, 2005 and published as U.S. Application No. US-2006-0020396-A1, which is a continuation of U.S. application Ser. No. 10/658,355, to Rene Gantier, Thierry Guyon, Hugo Cruz Ramos, Manuel Vega and Lila Drittanti entitled "RATIONAL DIRECTED PROTEIN EVOLUTION USING TWO-DIMENSIONAL RATIONAL MUTAGENESIS SCANNING", filed Sep. 8, 2003 and published as U.S.

This application also is related to U.S. application Ser. No. 10/658,834, filed Sep. 8, 2003, and to published International PCT Application WO 2004/022593, to Rene Gantier, Thierry Guyon, Manuel Vega and Lila Drittanti entitled, "RATIONAL EVOLUTION OF CYTOKINES FOR HIGHER STABILITY, THE CYTOKINES AND ENCODING NUCLEIC ACID MOLECULES." This application also is related to U.S. application Ser. No. 10/658,355, filed Sep. 8, 2003, and to International PCT Application WO 2004/022747, to Rene Gantier, Thierry Guyon, Hugo Cruz Ramos, Manuel Vega and Lila Drittanti entitled "RATIONAL DIRECTED PROTEIN EVOLUTION USING TWO-DIMENSIONAL RATIONAL MUTAGENESIS SCANNING."

Where permitted the subject matter of each of the above-referenced applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Jun. 14, 2007, is identical, 6,982 kilobytes in size, and titled 930SEQ.001.txt.

FIELD OF INVENTION

Modified coagulation factor IX (factor IX; FIX; F9) polypeptides are provided. The FIX polypeptides are modified to exhibit physical properties and activities that differ from unmodified and wild-type FIX polypeptides. Nucleic acid molecules encoding these polypeptides also are provided. Also provided are methods of treatment and diagnosis using the modified FIX polypeptides.

BACKGROUND

Effective delivery of therapeutic proteins for clinical use is a major challenge to pharmaceutical science. Once in the blood stream, these proteins are constantly eliminated from circulation within a short time by different physiological processes, involving metabolism as well as clearance using normal pathways for protein elimination, such as (glomerular) filtration in the kidneys or proteolysis in blood. Once in the luminal gastrointestinal tract, these proteins are constantly digested by luminal proteases. The latter can be a limiting process affecting the half-life of proteins used as therapeutic agents in per-oral administration and either intravenous or intramuscular injection. The problems associated with these routes of administration of proteins are known and various strategies have been used in attempts to solve them.

A protein family that has been the focus of clinical work and effort to improve its administration and bio-assimilation is the blood coagulation factor family, which includes procoagulation factors, such as factor IX (FIX) and factor VIII (FVIII). Deficiencies in the levels of functional coagulation pathway proteins can cause mild to severe bleeding disorders. For example, hemophilia A and B are inherited diseases characterized by deficiencies in FVIII and FIX polypeptides, respectively. The underlying cause of the deficiencies is frequently the result of mutations in FVIII and FIX genes, both of which are located on the X chromosome. Traditional therapy for hemophilias often involves intravenous administration of pooled plasma or semi-purified coagulation factors from normal individuals. These preparations can be contaminated by pathogenic agents or viruses, such as infectious prions, HIV, parvovirus, hepatitis A, and hepatitis C. Hence, there is an urgent need for therapeutic agents that do not require the use of human serum.

Recombinantly produced FIX polypeptides have been approved for procoagulation treatment of hemophilia. Also of therapeutic interest are FIX polypeptides that lack peptidase activity and can have anticoagulant activities useful in the treatment of thrombolytic diseases. Hence, FIX along with other coagulation factors are important therapeutic agents for procoagulant and anticoagulation therapies. Since naturally occurring variants can have undesirable side effects as well as the problems of administration, bioavailability, and short half-life, there is a need to improve properties of FIX for its use as a biotherapeutic agent. Therefore, among the objects herein, it is an object to provide modified FIX polypeptides that have improved therapeutic properties.

SUMMARY

Provided herein are modified Factor IX (FIX) polypeptides that exhibit increased protein stability compared to an unmodified FIX polypeptide. The modified FIX polypeptides provided herein are mutant variants of FIX that display improved protein stability. Modified FIX polypeptides provided herein exhibiting increased protein stability display increased protein half-life in vivo or in vitro compared to an unmodified FIX polypeptide. For example, modified FIX polypeptides provided herein exhibit increased stability in the bloodstream, following oral administration, and/or under storage conditions. Increased protein stability of a modified FIX provided herein can be manifested as increased resistance to digestion by proteases. Such increased stability includes stability as assessed by resistance to blood, intestinal or any other proteases.

Provided herein are modified FIX polypeptides containing one or more amino acid modifications corresponding to amino acid positions E36, R37, T39, E40, S61, S68, E70, P74, K80, D85, T87, S102, E119, K122, E125, P126, P129, R134, S136, T144, E147, P151, D166, T169, S171, T172, S174, D177, E224, T225, T241, E242, T244, K247, E294, T371, E372, and L414 of a mature FIX polypeptide set forth in SEQ ID NO: 2 or 1035. For example, amino acid replacements at any one of the one or more amino acid positions can include replacements of any of E36Q, E36H, E36N, R37H, R37Q, T39Q, T39H, T39N, E40Q, E40H, E40N, S61Q, S61H, S61N, S68Q, S68H, S68N, E70Q, E70H, E70N, P74A, P74S, K80N, K80Q, D85N, D85Q, T87Q, T87H, T87N, S102Q, S102H, S102N, K122N, K122Q, E125Q, E125H, E125N, P126A, P126S, P129A, P129S, R134H, R134Q, S136Q, S136H, S136N, S138Q, T144Q, T144H, T144N, E147Q, E147H, E147N, P151A, P151S, D166N, D166Q, T169Q, T169H, T169N, S171Q, S171H, S171N, T172Q, T172H, T172N, S174Q, S174H, S174N, D177N, D177Q, E224Q, E224H, E224N, T225Q, T225H, T225N, T241Q, T241H, T241N, E242Q, E242H, E242N, T244Q, T244H, T244N, K247N, K247Q, E294Q, E294H, E294N, T371Q, T371H, T371N, E372Q, E372H, E372N, L414I, and L414V of a mature FIX polypeptide set forth in SEQ ID NO: 2 or 1035.

Provided herein are modified FIX polypeptides containing one or more amino acid modifications corresponding to any of FIX polypeptides with modifications corresponding to Y1I, S3Q, S3H, S3N, G4Q, G4H, G4N, K5N, K5Q, L61, L6V, E7Q, E7H, E7N, E8Q, E8H, E8N, F9V, E15Q, E15N, R16H, R16Q, E17H, E17N, E20Q, E20H, E20N, E21Q, E21H, E21N, K22N, K22Q, S24Q, S24N, F25V, E26H, E26N, E27Q, E27N, R29H, E30Q, E30N, F32I, F32V, T35Q, T35H, T35N, T38Q, T38H, T38N, F41I, K43N, K43Q, Y45I, D47Q, G48Q, G48H, G48N, D49N, E52Q, E52H, E52N, S53Q, S53N, L57V, N58Q, N58S, G59Q, G59H, G59N, G60Q, G60N, K63N, K63Q, D64Q, D65N, D65Q, Y69I, F75I, F75V, G76Q, G76H, G76N, F77I, F77V, E78Q, E78H, E78N, G79Q, G79H, G79N, E83Q, E83H, E83N, L84I, L84V, K91N, K91Q, N92Q, R94N, R94Q, E96Q, E96H, E96N, F98I, F98V, K100N, K100Q, D104N, D104Q, K106N, K106Q, S110Q, S110H, S110N, T112Q, T112H, T112N, E113Q, E113N, Y115I, R116H, R116Q, L171, L117V, E119Q, E119H, E 119N, S123Q, S123N, A127Q, A127H, A127N, P131A, G133Q, G133H, G133N, S138N, T140Q, T140N, S141Q, S141H, S141N, K142N, K142Q, R145Q, A146Q, A146H, A146N, T148Q, T148N, D152N, D152Q, D154N, Y155I, S158H, S18N, T159Q, T159H, T159N, E160Q, E160H, E160N, E162Q, E162H, E162N, T163Q, T163H, T163N, L165I, L165V, F175I, F175V, F178I, F178V, T179Q, T179H, T179N, E185Q, E185N, D186N, D186Q, K188N, K188Q, P189A, P189S, F192I, P193A, W194I, L198V, N199Q, G200Q, G200H, G200N, D203N, D203Q, F205I, G207Q, G207H, G207N, S209Q, S209H, S209N, E213Q, E213N, K214N, K214Q, T218Q, T218H, T218N, A219Q, A219N, A220Q, A220H, A220N, G226Q, G226H, G226N, K228N, K228Q, T230Q, T230H, T230N, E239Q, E239H, E239N, E240Q, E240H, E245Q, E245H, E245N, R248H, R252H, R252Q, P255A, P255S, Y259I, K265N, K265Q, Y266I, L272I, L272V, E274Q, E274H, E274N, L275I, L275V, D276N, D276Q, E277Q, E277H, E277N, P278A, P278S, S283Q, S283H, S283N, Y284I, T286Q, T286H, T286N, P287A, P287S, D292N, D292Q, K293N, K293Q, Y295I, T296Q, T296H, T296N, F299I, K301N, K301Q, F302I, F302V, G303Q, G303N, S304Q, S304H, S304N, Y306I, S308Q, S308H, G309Q, G309H, G309N, G311Q, G311N, R312H, R312Q, F314V, K316N, K316Q, R318H, R318Q, L321I, L321V, Y325I, R327H, R327Q, P329A, P329S, D332N, D332Q, T335Q, T335H, T335N, L337V, R338H, R338Q, S339Q, S339H, S339N, T340Q, T340H, T340N, K341Q, F342I, F342V, T343Q, T343H, T343N, Y345I, F349V, G352Q, G352H, G352N, F353V, G363Q, G363H, G363N, D364Q, S365Q, S365H, G366Q, G366H, G366N, G367Q, G367H, G367N, P368A, E374Q, E374H, E374N, G375Q, G375N, T376Q, T376H, S377Q, S377H, S377N, F378I, L379V, T380Q, T380H, T380N, S384Q, S384H, G386Q, G386H, G386N, E387Q, E387N, M391V, K392N, K392Q, K394Q, Y395I, G396Q, G396H, G396N, I397Q, I397H, I397N, Y398I, T399Q, T399H, K400Q, S402Q, S402H, S402N, R403H, Y404I, K409N, K409Q, E410Q, E410N, K411N, K411Q, T412Q, T412H, T412N, K413N, K413Q, T415Q, T415H, and T415N of the mature FIX polypeptide set forth in SEQ ID NO: 2 or 1035. In a particular example, the modifications in FIX polypeptide are any of T163N, T163H, I164N, I164Q, L165I, I168N, I168H, T169N, T169Q, T169H, S171N, S171Q, S171H, T172Q, T172H, S174N, S174Q, S174H, F175I, T179N, T179Q, T179H, D203Q, and D203N of the mature FIX polypeptide set forth in SEQ ID NO: 2 or 1035. In another example, the modifications in FIX polypeptide are any of D152Q, D154N, T163H, I164N, I164H, D166Q, D166N, I168Q, I168H, T169H, S171N, S171Q, T172Q, S174Q, S174H, F175H, D177Q, D177N, T179N, T179Q, T179H, T179N, T179Q, T179H, V181Q, V182N, G184N, D186Q, D186N, A187Q, F192I, V197H, L198I, L198V, D203Q, and D203N of the mature FIX polypeptide set forth in SEQ ID NO: 2 or 1035. In yet another example, the modifications in FIX polypeptide are any of T163H, I164Q, I168H, T169H, S171N, S171Q, T172Q, S174Q, S174H, T179N, T179Q, T179H, D203Q, and D203N of the mature FIX polypeptide set forth in SEQ ID NO: 2 or 1035.

Provided herein are modified FIX polypeptides containing two or more amino acid modifications corresponding to modifications at any two or more positions of Y1, S3, G4, K5, L6, E7, E8, F9, V10, G12, L14, E15, R16, E17, M19, E20, E21, K22, S24, F25, E26, E27, A28, R29, E30, V31, F32, E33, T35, E36, R37, T38, T39, E40, F41, W42, K43, Y45, V46, D47, G48, D49, E52, S53, P55, L57, N58, G59, G60, S61, K63, D64, D65, I66, S68, Y69, E70, W72, P74, F75, G76, F77, E78, G79, K80, E83, L84, D85, V86, T87, I90, K91, N92, G93, R94, E96, F98, K100, S102, A103, D104, K106, V107, V108, S110, T112, E113, G114, Y115, R116, L117, A118, E119, K122, S123, E125, P126, A127, V128, P129, P131, G133, R134, V135, S136, V137, S138, T140, S141, K142, L143, T144, R145, A146, E147, T148, V149, P151, D152, V153, D154, Y155, V156, S158, T159, E160, A161, E162, T163, I164, L165, D166, I168, T169, S171, T172, S174, F175, D177, T179, R180, V181, V182, G183, G184, E185, D186, A187, K188, P189, G190, F192, P193, W194, V196, V197, L198, N199, G200, K201, V202, D203, A204, F205, G207, G208, S209, I210, V211, E213, K214, W215, I216, V217, T218, A219, A220, V223, E224, T225, G226, V227, K228, I229, T230, V231, V232, A233, G234, E235, I238, E239, E240, T241, E242, T244, E245, K247, R248, V250, I251, R252, I253, I254, P255, Y259, A261, A262, I263, K265, Y266, D269, I270, A271, L272, L273, E274, L275, D276, E277, P278, L279, V280, L281, S283, Y284, V285, T286, P287, I288, I290, A291, D292, K293, E294, Y295, T296, I298, F299, L300, K301, F302, G303, S304, G305, Y306, V307, S308, G309, W310, G311, R312, V313, F314, K316, G317, R318, S319, A320, L321, V322, L323, Y325, L326, R327, V328, P329, L330, V331, D332, R333, A334, T335, L337, R338, S339, T340, K341, F342, T343, I344, Y345, M348, F349, A351, G352, F353, E355, G356, G357, R358, D359, S360, G363, D364, S365, G366, G367, P368, V370, T371, E372, V373, E374, G375, T376, S377, F378, L379, T380, G381, I382, I383, S384, W385, G386, E387, E388, A390, M391, K392, G393, K394, Y395, G396, I397, Y398, T399, K400, V401, S402, R403, Y404, V405, W407, I408, K409, E410, K411, T412, K413, L414, and T415 of a mature FIX polypeptide set forth in SEQ ID NO: 2 or 1035. For example, amino acid amino acid replacements at any two or more of the amino acid positions can include replacements of any of Y1H, Y1I, S3Q, S3H, S3N, G4Q, G4H, G4N, K5N, K5Q, L6I, L6V, E7Q, E7H, E7N, E8Q, E8H, E8N, F9I, F9V, V10Q, V10H, V10N, G12Q, G12H, G12N, L14I, L14V, E15Q, E15H, E15N, R16H, R16Q, E17Q, E17H, E17N, M19I, M19V, E20Q, E20H, E20N, E21Q, E21H, E21N, K22N, K22Q, S24Q, S24H, S24N, F25I, F25V, E26Q, E26H, E26N, E27Q, E27H, E27N, A28Q, A28H, A28N, R29H, R29Q, E30Q, E30H, E30N, V31Q, V31H, V31N, F32I, F32V, E33Q, E33H, E33N, T35Q, T35H, T35N, E36Q, E36H, E36N, R37H, R37Q, T38Q, T38H, T38N, T39Q, T39H, T39N, E40Q, E40H, E40N, F41I, F41V, W42S, W42H, K43H, K43Q, Y45H, Y45I, V46Q, V46H, V46N, D47N, D47Q, G48Q, G48H, G48N, D49N, D49Q, E52Q, E52H, E52N, S53Q, S53H, S53N, P55A, P55S, L57I, L57V, N58Q, N58S, G59Q, G59H, G59N, G60Q, G60H, G60N, S61Q, S61H, S61N, K63N, K63Q, D64N, D64Q, D65Q, I66Q, I66H, I66N, S68Q, S68H, S68N, Y69H, Y69I, E70Q, E70H, E70N, W72S, W72H, P74A, P74S, F75I, F75V, G76Q, G76H, G76N, F77I, F77V, E78Q, E78H, E78N, G79Q, G79H, G79N, K80N, E83Q, E83H, E83N, L84I, L84V, D85N, D85Q, V86Q, V86H, V86N, T87Q, T87H, T87N, I90Q, I90H, I90N, K91N, K91Q, N92Q, N92S, G93Q, G93H, G93N, R94Q, R94H, E96Q, E96H, E96N, F98I, F98V, K100N, K100Q, S107Q, S102H, S102N, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L17I, L117V, A118Q, A118H, A118N, E119Q, E119H, E119N, K122N, K122Q, S123Q, S123H, S123N, E125Q, E125H, E125N, P126A, P126S, A127Q, A127H, A127N, V128Q, V128H, V128N, P129A, P129S, P131A, P131S, G133Q, G133H, G133N, R134H, R134Q, V135Q, V135H, V135N, S136Q, S136H, S136N, V137Q, V137H, V137N, S138Q, S138H, S138N, T140Q, T140H, T140N, S141Q, S141H, S141N, K142N, K142Q, L143I, L143V, T144Q, T144H, T144N, R145H, R145Q, A146Q, A146H, A146N, E147Q, E147H, E147N, T148Q, T148H, T148N, V149Q, V149H, V149N, P151A, P151S, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, D166N, D166Q, I168Q, I168H, I168N, T169Q, T169H, T169N, S171Q, S171H, S171N, T172Q, T172H, T172N, S174Q, S174H, S174N, F175I, F175V, F175H, D177N, D177Q, F178I, F178V, F178H, T179Q, T179H, T179N, R180H, R180Q, V181Q, V181H, V181N, V182Q, V182H, V182N, G183Q, G183H, G183N, G184Q, G184H, G184N, E185Q, E185H, E185N, D186N, D186Q, A187Q, A187H, A187N, K188N, K188Q, P189A, P189S, G190Q, G190H, G190N, F192I, F192V, F192H, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203N, D203Q, A204Q, A204H, A204N, F205I, F205V, G207Q, G207H, G207N, G208Q, G208H, G208N, S209Q, S209H, S209N, I210Q, I210H, I210N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, E224Q, E224H, E224N, T225Q, T225H, T225N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, T241Q, T241H, T241N, E242Q, E242H, E242N, T244Q, T244H, T244N, E245Q, E245H, E245N, K247N, K247Q, R248H, R248Q, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, E294Q, E294H, E294N, Y295H, Y295I, T296Q, T296H, T296N, I298Q, I298H, I298N, F299I, F299V, L300I, L300V, K301Q, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316N, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332Q, D332Q, R333H, R333Q, A334Q, A334H, A334N, T335Q, T335H, T335N, L337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351N, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, S365Q, S365H, S365N, G366Q, G366H, G366N, G367Q, G367H, G367N, P368A, P368S, V370Q, V370H, V370N, T371Q, T371H, T371N, E372Q, E372H, E372N, V373Q, V373H, V373N, E374Q, E374H, E374N, G375Q, G375H, G375N, T376Q, T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395H, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E410Q, E410H, E410N, K411N, K411Q, T412Q, T412H, T412N, K413N, K413Q, L414I, L414V, T415Q, T415H, and T415N of a mature FIX polypeptide set forth in SEQ ID NO: 2 or 1035.

Provided herein are any of the above modified FIX polypeptides above that are further modified at one or more positions corresponding to amino acid positions Y1, S3, G4, K5, L6, E7, E8, F9, V10, G12, L14, E15, R16, E17, M19, E20, E21, K22, S24, F25, E26, E27, A28, R29, E30, V31, F32, E33, T35, F41, W42, K43, Y45, V46, D47, G48, D49, E52, S53, P55, L57, N58, G59, G60, K63, D64, D65, I66, Y69, W72, F75, G76, F77, E78, G79, E83, L84, V86, I90, K91, N92, G93, R94, E96, F98, K100, A103, D104, K106, V107, V108, S110, T112, E113, G114, Y115, R116, L117, A118, S123, A127, V128, P131, G133, V135, V137, S138, T140, S141, K142, L143, R145, A146, T148, V149, D152, V153, D154, Y155, V156, S158, T159, E160, A161, E162, T163, I164, L165, I168, F175, F178, T179, R180, V181, V182, G183, G184, E185, D186, A187, K188, P189, G190, F192, P193, W194, V196, V197, L198, N199, G200, K201, V202, D203, A204, F205, G207, G208, S209, I210, V211, E213, K214, W215, I216, V217, T218, A219, A220, V223, G226, V227, K228, I229, T230, V231, V232, A233, G234, E235, I238, E239, E240, E245, R248, V250, I251, R252, I253, I254, P255, Y259, A261, A262, I263, K265, Y266, D269, I270, A271, L272, L273, E274, L275, D276, E277, P278, L279, V280, L281, S283, Y284, V285, T286, P287, I288, I290, A291, D292, K293, Y295, T296, I298, F299, L300, K301, F302, G303, S304, G305, Y306, V307, S308, G309, W310, G311, R312, V313, F314, K316, G317, R318, S319, A320, L321, V322, L323, Y325, L326, R327, V328, P329, L330, V331, D332, R333, A334, T335, L337, R338, S339, T340, K341, F342, T343, I344, Y345, M348, T349, A351, G352, F353, E355, G356, G357, R358, D359, S360, G363, D364, S365, G366, G367, P368, G370, V373, E374, G375, T376, S377, F378, L379, T380, G381, I382, I383, S384, W385, G386, E387, E388, A390, M391, K392, G393, K394, Y395, G396, I397, Y398, T399, K400, V401, S402, R403, Y404, V405, W407, I408, K409, E410, K411, T412, K413, and T415 of the mature FIX polypeptide set forth in SEQ ID NO: 2 or 1035. For example, amino acid replacements at any one of the one or more further amino acid positions can include replacements of any of Y1H, Y1I, S3Q, S3H, S3N, G4Q, G4H, G4N, K5N, K5Q, L6I, L6V, E7Q, E7H, E7N, E8Q, E8H, E8N, F9I, F9V, V10Q, V10H, V10N, G12Q, G12H, G12N, L14I, L14V, E15Q, E15H, E15N, R16H, R16Q, E17Q, E17H, E17N, M19I, M19V, E20Q, E20H, E20N, E21Q, E21H, E21N, K22N, K22Q, S24Q, S24H, S24N, F25I, F25V, E26Q, E26H, E26N, E27Q, E27H, E27N, A28Q, A28H, A28N, R29H, R29Q, E30Q, E30H, E30N, V31Q, V31H, V31N, F32I, F32V, E33Q, E33H, E33N, T35Q, T35H, T35N, E38Q, E38H, E38N, F41I, F41V, W42S, W42H, K43N, K43Q, Y45H, Y45I, V46Q, V46H, V46N, D47Q, D47N, G48Q, G48H, G48N, D49N, D49Q, E52Q, E52H, E52N, S53Q, S53H, S53N, P55A, P55S, L57I, L57V, N58Q, N58S, G59Q, G59H, G59N, G60Q, G60H, G60N, K63N, K63Q, D64Q, D64N, D65N, D65Q, I66Q, I66H, I66N, Y69H, Y69I, W72S, W72H, F75I, F75V, G76Q, G76H, G76N, F77I, F77V, E78Q, E78H, E78N, G79Q, G79H, G79N, E83Q, E83H, E83N, L84I, L84V, V86Q, V86H, V86N, I90Q, I90H, I90N, K91N, K91Q, N92Q, N92S, G93Q, G93H, G93N, R94H, R94Q, E96Q, E96H, E96N, F98I, F98V, K100N, K100Q, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L117I, L117V, A118Q, A118H, A118N, S123Q, S123H, S123N, A127Q, A127H, A127N, V128Q, V128H, V128N, P131A, P131S, G133Q, G133H, G133N, V135Q, V135H, V135N, V137Q, V137H, V137N, S138Q, S138H, S138N, T140Q, T140H, T140N, S141Q, S141H, S141N, K142Q, K142N, L143I, L143V, R145H, R145Q, A146Q, A146H, A146N, T148Q, T148H, T148N, V149Q, V149H, V149N, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, I168Q, I168H, I168N, F175I, F175V, F175H, F178I, F178V, F178H, T179Q, T179N, R180H, R180Q, V181Q, V181H, V181N, V182Q, V182H, V182N, G183Q, G183H, G183N, G184Q, G184H, G184N, E185Q, E185H, E185N, D186N, D186Q, A187Q, A187H, A187N, K188N, K188Q, P189A, P189S, G190Q, G190H, G190N, F192I, F192V, F192H, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203N, D203Q, A204Q, A204H, A204N, F205I, F205V, G207Q, G207H, G207N, G208Q, G208H, G208N, S209Q, S209H, S209N, I210Q, I210H, I210N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, E245Q, E245H, E245N, R248H, R248Q, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, Y295H, Y295I, T296Q, T296H, T296N, I298Q, I298H, I298N, F299I, F299V, L300I, L300V, K301N, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316N, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332N, D332Q, R333H, R333Q, A334Q, A334H, A334N, T335Q, T335H, T335N, L337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351I, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, D365Q, S365H, S365N, G366Q, G366H, G366N, G367Q, G367H, G3.67N, P368A, P368S, V370Q, V370H, V370N, V373Q, V373H, V373N, E374Q, E374H, E374N, G375Q, G375H, G375N, T376Q, T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395H, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E40Q, E410H, E410N, K411N, K411Q, T412Q, T412H, T412N, K413N, K413Q, T415Q, T415H, and T415N of the mature FIX polypeptide set forth in SEQ ID NO: 2 or 1035.

Provided herein are modified FIX polypeptides containing an amino acid modification at a position corresponding to amino acid residue F192 of a mature FIX polypeptide set forth in SEQ ID NO: 2 or 1035. Provided herein is a modified FIX polypeptide in which the amino acid modification at position F192 is a replacement of phenylalanine (F) by isoleucine (I), valine (V), or histidine (H). In a particular example, the amino acid modification at position F192 is isoleucine (I). Provided herein are modified FIX polypeptides containing an amino acid modification at F192 that also contains a further amino acid modification at another position. For example, such a modified FIX polypeptide has 2, 3, 4, 5, 6, 7, 8, 9, 10, 11, 12, 13, 14, 15, 16, 17, 18, 19, or 20 modifications. In one example, the further amino acid replacement is at positions corresponding to any of amino acid positions Y1, S3, G4, K5, L6, E7, E8, F9, V10, G12, L14, E15, R16, E17, M19, E20, E21, K22, S24, F25, E26, E27, A28, R29, E30, V31, F32, E33, T35, F41, W42, K43, Y45, V46, D47, G48, D49, E52, S53, P55, L57, N58, G59, G60, K63, D64, D65, I66, Y69, W72, F75, G76, F77, E78, G79, E83, L84, V86, I90, K91, N92, G93, R94, E96, F98, K100, A103, D104, K106, V107, V108, S110, T112, E113, G114, Y115, R116, L117, A118, S123, A127, V128, P131, G133, V135, V137, S138, T140, S141, K142, L143, R145, A146, T148, V149, D152, V153, D154, Y155, V156, S158, T159, E160, A161, E162, T163, I164, L165, I168, F175, F178, T179, R180, V181, V182, G183, G184, E185, D186, A187, K188, P189, G190, F192, P193, W194, V196, V197, L198, N199, G200, K201, V202, D203, A204, F205, G207, G208, S209, I210, V211, E213, K214, W215, I216, V217, T218, A219, A220, V223, G226, V227, K228, I229, T230, V231, V232, A233, G234, E235, I238, E239, E240, E245, R248, V250, I251, R252, I253, I254, P255, Y259, A261, A262, I263, K265, Y266, D269, I270, A271, L272, L273, E274, L275, D276, E277, P278, L279, V280, L281, S283, Y284, V285, T286, P287, I288, I290, A291, D292, K293, Y295, T296, I298, F299, L300, K301, F302, G303, S304, G305, Y306, V307, S308, G309, W310, G311, R312, V313, F314, K316, G317, R318, S319, A320, L321, V322, L323, Y325, L326, R327, V328, P329, L330, V331, D332, R333, A334, T335, L337, R338, S339, T340, K341, F342, T343, I344, Y345, M348, F349, A351, G352, F353, E355, G356, G357, R358, D359, S360, G363, D364, S365, G366, G367, P368, V370, V373, E374, G375, T376, S377, F378, L379, T380, G381, I382, I383, S384, W385, G386, E387, E388, A390, M391, K392, G393, K394, Y395, G396, I397, Y398, T399, K400, V401, S402, R403, Y404, V405, W407, I408, K409, E410, K411, T412, K413, and T415 of the mature FIX polypeptide set forth in SEQ ID NO: 2 or 1035. For example, amino acid replacements at any one of the further amino acid positions can include replacements of any of Y1I, S3Q, S3H, S3N, G4Q, G4H, G4N, K5N, K5Q, L6I, L6V, E7Q, E7H, E7N, E8Q, E8H, E8N, F91, F9V, V10Q, V10H, V10N, G12Q, G12H, G12N, L141, L14V, E15Q, E15H, E15N, R16H, R16Q, E17Q, E17H, E17N, M191, M19V, E20Q, E20H, E20N, E21Q, E21H, E21N, K22N, K22Q, S24Q, S24H, S24N1, F251, F25V, E26Q, E26H, E26N, E27Q, E27H, E27N, A28Q, A28H, A28N, R29H, R29Q, E30Q, E30H, E30N, V31Q, V31H, V31N, F32I, F32V, E33Q, E33H, E33N, T35Q, T35H, T35N, E36Q, E36H, E36N, R37H, R37Q, T38Q, T38H, T38N, T39Q, T39H, T39N, E40Q, E40H, E40N, F41I, F41V, W42S, W42H, K43N, K43Q, Y45H, Y451, V46Q, V46H, V46N, D47N, D47Q, G48Q, G48H, G48N, D49N, D49Q, E52Q, E52H, E52N, S53Q, S53H, S53N, P55A, P55S, L571, L57V, N58Q, N58S, G59Q, G59H, G59N, G60Q, G60H, G60N, S61Q, S61H, S61N, K63N, K63Q, D64N, D64Q, D65N, D65Q, I66Q, I66H, I66N, S68Q, S68H, S68N, Y69H, Y691, E70Q, E70H, E70N, W72S, W72H, P74A, P74S, F751, F75V, G76Q, G76H, G76N, F771, F77V, E78Q, E78H, E78N, G79Q, G79H, G79N, K80N, K80Q, E83Q, E83H, E83N, L841, L84V, D85N, D85Q, V86Q, V86H, V86N, T87Q, T87H, T87N, I90Q, I90H, I90N, K91N, K91Q, N92Q, N92S, G93Q, G93H, G93N, R94H, R94Q, E96Q, E96H, E96N, F98I, F98V, K100N, K100Q, S102Q, S102H, S102N, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L117I, L117V, A118Q, A118H, A118N, E119Q, E119H, E119N, K122N, K122Q, S123Q, S123H, S123N, E125Q, E125H, E125N, P126A, P126S, A127Q, A127H, A127N, V128Q, V128H, V128N, P129A, P129S, P131A, P131S, G133Q, G133H, G13.3N, R134H, R134Q, V135Q, V135H, V135N, S136Q, S136H, S136N, V137Q, V137H, V137N, S138Q, S138H, S138N, T140Q, T140H, T140N, S141Q, S141H, S141N, K142N, K142Q, L143I, L143V, T144Q, T144H, T144N, R145H, R145Q, A146Q, A146H, A146N, E147Q, E147H, E147N, T148Q, T148H, T148N, V149Q, V149H, V149N, P151A, P151S, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, D166N, D166Q, I168Q, I168H, I168N, T169Q, T169H, T169N, S171Q, S171H, S171N, T172Q, T172H, T172N, S174Q, S174H, S174N, F175I, F175V, F175H, D177N, D177Q, F178I, F178V, F178H, T179Q, T179H, T179N, R180H, R180Q, V181Q, V181H, V181N, V182Q, V182H, V182N, G183Q, G183H, G183N, G184Q, G184H, G184N, E185Q, E185H, E185N, D186N, D186Q, A187Q, A187H, A187N, K188N, K188Q, P189A, P189S, G190Q, G190H, G190N, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203N, D203Q, A204Q, A204H, A204N, F205I, F205V, G207Q, G207H, G207N, G208Q, G208H, G208N, S209Q, S209H, S209N, I210Q, I210H, I210N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, E224Q, E224H, E224N, T225Q, T225H, T225N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, T241Q, T241H, T241N, E242Q, E242H, E242N, T244Q, T244H, T244N, E245Q, E245H, E245N, K247N, K247Q, R248H, R248Q, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, E294Q, E294H, E294N, Y295H, Y295I, T296Q, T296H, T296N, I298Q, I298H, I298N, F299I, F299V, L300I, L300V, K301N, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316N, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332N, D332Q, R333H, R333Q, A334Q, A334H, A334N, T335Q, T335H, T335N, L337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351N, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, S365Q, S365H, S365N, G366Q, G366H, G366N, G367Q, G367H, G367N, P368A, P368S, V370Q, V370H, V370N, T371Q, T371H, T371N, E372Q, E372H, E372N, V373Q, V373H, V373N, E374Q, E374H, E374N, G375Q, G375H, G375N, T376Q, T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395H, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E410Q, F410H, E410N, K411N, K411Q, T412Q, T412H, T412N, K413N, K413Q, L414I, L414V, T415Q, T415H, and T415N of a mature FIX polypeptide set forth in SEQ ID NO: 2 or 1035.

In some examples, exemplary amino acid modifications of a FIX polypeptide include amino acid modifications of any of T163H/F192I, I164Q/F192I, T169H/F192I, S171Q/F192I, D152N/D154N/F192I, S174Q/F192I, S174H/F192I, T179Q/F192I, T179H/F192I, T163N/I164N/F192I, D166Q/F192I, D166N/F192I, D186Q/F192I, D186N/F192I, T148A/D152N/D154N/F192I, F192I/D203Q, F192I/D203N, D152N/F192I, D152Q/F192I, T148A/D154N/F192I, D154N/F192I, D154Q/F192I, T163N/I164N, A187N/G190N, V196N/V197N, T140N/T144N, F175I/F178I, F192I/W194I, T148A/D152N, T148A/D152Q, T148A/D154N, T148A/D154Q, D152N/D154N, I168N/T169N/S171N/T172N/S174N, T179N/V181N/V182N/G183N/G184N, D152N/D154N/T148A, T163H/D166Q/F192I, T163H/D166N/F192I, T163H/D186Q/F192I, T163H/D186N/F192I, T163H/F192I/D203Q, T163H/F192I/D203N, T148A/D152N/D154N/T163H/F192I, T148A/D154N/T163H/F192I, I164Q/D166Q/F192I, I164Q/D166N/F192I, I164Q/D186Q/F192I, I164Q/D186N/F192I, I164Q/F192I/D203Q, I164Q/F192I/D203N, T148A/D152N/D154N/I164Q/F192I, T148A/D154N/I164Q/F192I, T163N/I164N/D166Q/F192I, T163N/I164N/D166N/F192I, T163N/I164N/D186Q/F192I, T163N/164N/D186N/F192I, T163N/I164N/F192I/D203Q, T163N/I164N/F192I/D203N, T148A/D152N/D154N/T163N/I164N/F192I, T148A/D154N/T163N/I164N/F192I, D166Q/T169H/F192I, D166N/T169H/F192I, T169H/D186Q/F192I, T169H/D186N/F192I, T169H/F192I/D203Q, T169H/F192I/D203N, T148A/D152N/D154N/T169H/F192I, T148A/D154N/T169H/F192I, D166Q/S171Q/F192I, D166N/S171Q/F192I, S171Q/D186Q/F192I, S171Q/D186N/F192I, S171Q/F192I/D203Q, S171Q/F192I/D203N, T148A/D152N/D154N/S171Q/F192I, T148A/D154N/S171Q/F192I, D166Q/S174Q/F192I, D166N/S174Q/F192I, S174Q/D186Q/F192I, S174Q/D186N/F192I, S174Q/F192I/D203Q, S174Q/F192I/D203N, T148A/D152N/D154N/S174Q/F192I, T148A/D154N/S174Q/F192I, D166Q/S174H/F192I, D166N/S174H/F192I, S174H/D186Q/F192I, S174H/D186N/F192I, S174H/F192I/D203Q, S174H/F192I/D203N, T148A/D152N/D154N/S174H/F192I, T148A/D154N/S174H/F192I, D166Q/T179Q/F192I, D166N/T179Q/F192I, T179Q/D186Q/F192I, T179Q/D186N/F192I, T179Q/F192I/D203Q, T179Q/F192I/D203N, T148A/D152N/D154N/T179Q/F192I, T148A/D154N/T179Q/F192I, D166Q/T179H/F192I, D166N/T179H/F192I, T179H/D186Q/F192I, T179H/D186N/F192I, T179H/F192I/D203Q, T179H/F192I/D203N, T148A/D152N/D154N/T179H/F192I, and T148A/D154N/T179H/F192I of a mature FIX polypeptide set forth in SEQ ID NO: 2 or 1035. For example, a modified FIX polypeptide provided herein has a sequence of amino acids set forth in any of SEQ ID NOS: 917-1024 or 1927-2034. In particular examples, the modifications in FIX polypeptide are any of D186Q/F192I, T148A/D152N/D154N/F192I, T163H/D166Q/F192I, T163H/F192I/D203Q, T148A/D154N/T163H/F192I, I164Q/F192I/D203Q, I164Q/F192I/D203N, T148A/D154N/T163N/I164N/F192I, T169H/F192I/D203N, S174Q/F192I/D203Q, S174H/D186N/F192I, and T179Q/F192I/D203Q of a mature FIX polypeptide set forth in SEQ ID NO: 2 or 1035. In further examples, the modifications in FIX polypeptide are any of S174Q/F192I/D203Q, S174H/D186N/F192I, and T179Q/F192I/D203Q of a mature FIX polypeptide set forth in SEQ ID NO: 2 or 1035.

The modified FIX polypeptides provided herein include precursor forms and mature forms, such as modification of a wild-type human FIX polypeptide having a sequence of amino acids set forth in SEQ ID NO: 1 (precursor form) or SEQ ID NO: 2 or 1035 (mature forms). Mature forms of FIX polypeptides can include chimeric forms of FIX polypeptides such as set forth in SEQ ID NO: 1035, where homologous regions of coagulation factor family members, such as factor VII or factor X are inserted or replaced in the FIX amino acid sequence. Exemplary modified FIX polypeptides have a sequence of amino acids set forth in any of SEQ ID NOS: 3-891, 917-1034, or 1036-2044. It also is understood that amino acid modification of a FIX polypeptide can be in an allelic, species, or isoform variant of SEQ ID NO: 2 or 1035, where the allelic or species variant has 40%, 50%, 60%, 70%, 80%, 90%, 91%, 92%, 93%, 94%, 95%, 96%, 97%, 98%, or 99% sequence identity to the polypeptide set forth in SEQ ID NO: 2 or 1035, excluding the modified positions. A modified FIX polypeptide can beta human polypeptide or a non-human polypeptide. Modified loci are identified with reference to the amino acid numbering of a known unmodified mature FIX polypeptide having a sequence of amino acids set forth in SEQ ID NO: 2 or 1035. One of skill in the art can readily determine corresponding positions on a particular polypeptide, such as by alignment of unchanged residues. Furthermore, shortened or lengthened variants with insertions or deletions of amino acids, particularly at either terminus that retain an activity readily can be prepared and the loci for corresponding mutations identified.

In one example, provided herein is a modified structural homologue of a modified FIX as described herein containing one or more amino acid replacements in the structural homologue at positions corresponding to the 3-dimensional-structurally-similar positions within the 3-D structure of the modified FIX.

Modified FIX polypeptides provided herein include FIX polypeptides modified at 1, 2, 3, 4, 5, 6, 7, 8, 9, 10, 11, 12, 13, 14, 15, 16, 17, 18, 19, or 20 positions as compared to an unmodified FIX polypeptide. The modified FIX polypeptides provided herein exhibit increased protein stability compared to the unmodified FIX polypeptide. Provided herein are FIX polypeptides in which increased protein stability of the modified FIX polypeptide is the result of modification to the primary sequence of the FIX polypeptide. The increased protein stability exhibited by a FIX polypeptide can be manifested as increased protease resistance. In some cases, increased protein stability of a FIX polypeptide can be due to increased resistance to proteolysis that can occur in serum, blood, saliva, digestive fluids, or in vitro when exposed to one or more proteases. The increased resistance to proteolysis is exhibited by the modified FIX when it is administered intravenously, orally, nasally, pulmonarily, or is present in the digestive tract. Such modified FIX polypeptides exhibit increased resistance to proteolysis by one or more proteases compared to the unmodified FIX. For example, the proteases can by any of pepsin, trypsin, chymotrypsin, elastase, aminopeptidase, gelatinase B, gelatinase A, α-chymotrypsin, carboxypeptidase, endoproteinase Arg-C, endoproteinase Asp-N, endoproteinase Glu-C, endoproteinase Lys-C, luminal pepsin, microvillar endopeptidase, dipeptidyl peptidase, enteropeptidase, hydrolase, NS3, factor Xa, Granzyme B, thrombin, plasmin, urokinase, tPA and PSA.

In some examples, a modified FIX polypeptide exhibits increased protein stability due to increased protease resistance to elastase. Exemplary of those modified FIX polypeptides with increased protease resistance to elastase are those with modifications corresponding to S3Q, S3H, S3N, G4Q, G4H, G4N, V10Q, V10H, V10N, G12Q, G12H, G12N, S24Q, S24H, S24N, A28Q, A28H, A28N, V31Q, V31H, V31N, T35Q, T35H, T35N, T38Q, T38H, T38N, T39Q, T39H, T39N, V46Q, V46H, V46N, G48Q, G48H, G48N, S53Q, S53H, S53N, G59Q, G59H, G59N, G60Q, G60H, G60N, S61Q, S61H, S61N, I66Q, I66H, I66N, S68Q, S68H, S68N, G76Q, G76H, G76N, G79Q, G79H, G79N, V86Q, V86H, V86N, T87Q, T87H, T87N, I90Q, I90H, 190N, G93Q, G93H, G93N, S102Q, S102H, S102N, A103Q, A103H, A103N, V107Q, V107H, V107N, V108Q, V108H, V108N, S110Q, S110H, S110N, T112Q, T112H, T112N, G114Q, G114H, G114N, A118Q, A118H, A118N, S123Q, S123H, S123N, A127Q, A127H, A127N, V128Q, V128H, V128N, G133Q, G133H, G133N, V135Q, V135H, V135N, S136Q, S136H, S136N, V137Q, V137H, V137N, S138Q, S138H, S138N, T140Q, T140H, T140N, S141Q, S141H, S141N, T144Q, T144H, T144N, A146Q, A146H, A146N, T148Q, T148H, T148N, V149Q, V149H, V149N, V153Q, V153H, V153N, V156Q, V156H, V156N, S158Q, S158H, S158N, T159Q, T159H, T159N, A161Q, A161H, A161N, T163Q, T163H, T163N, I164Q, I164H, I164N, I168Q, I168H, I168N, T169Q, T169H, T169N, S171Q, S171H, S171N, T172Q, T172H, T172N, S174Q, S174H, S174N, T179Q, T179H, T179N, V181Q, V181H, V181N, V182Q, V182H, V182N, G183Q, G183H, G183N, G1.84Q, G184H, G184N, A187Q, A187H, A187N, G190Q, G190H, G190N, V196Q, V196H, V196N, V197Q, V197H, V197N, G200Q, G200H, G200N, V202Q, V202H, V202N, A204Q, A204H, A204N, G207Q, G207H, G207N, G208Q, G208H, G208N, S209Q, S209H, S209N, I210Q, I210H, I210N, V211Q, V211H, V211N, I216Q, I216H, I216N, V217Q, V217H, V217N, T218Q, T218H, T218N, A219Q, A219H, A219N, A220Q, A220H, A220N, V223Q, V223H, V223N, T225Q, T225H, T225N, G226Q, G226H, G226N, V227Q, V227H, V227N, I229Q, I229H, I229N, T230Q, T230H, T230N, V231Q, V231H, V231N, V232Q, V232H, V232N, A233Q, A233H, A233N, G234Q, G234H, G234N, I238Q, I238H, I238N, T241Q, T241H, T241N, T244Q, T244H, T244N, V250Q, V250H, V250N, I251Q, I251H, I251N, I253Q, I253H, I253N, I254Q, I254H, I254N, A261Q, A261H, A261N, A262Q, A262H, A262N, I263Q, I263H, I263N, I270Q, I270H, I270N, A271Q, A271H, A271N, V280Q, V280H, V280N, S283Q, S283H, S283N, V285Q, V285H, V285N, T286Q, T286H, T286N, I288Q, I288H, I288N, I290Q, I290H, I290N, A291Q, A291H, A291N, T296Q, T296H, T296N, I298Q, I298H, I298N, G303Q, G303H, G303N, S304Q, S304H, S304N, G305Q, G305H, G305N, V307Q, V307H, V307N, S308Q, S308H, S308N, G309Q, G309H, G309N, G311Q, G311H, G311N, V313Q, V313H, V313N, G317Q, G317H, G317N, S319Q, S319H, S319N, A320Q, A320H, A320N, V322Q, V322H, V322N, V328Q, V328H, V328N, V331Q, V331H, V331N, A334Q, A334H, A334N, T335Q, T335H, T335N, S339Q, S339H, S339N, T340Q, T340H, T340N, T343Q, T343H, T343N, I344Q, I344H, I344N, A351Q, A351H, A351N, G352Q, G352H, G352N, G356Q, G356H, G356N, G357Q, G357H, G357N, S360Q, S360H, S360N, G363Q, G363H, G363N, S365Q, S365H, S365N, G366Q, G366H, G366N, G367Q, G367H, G367N, V370Q, V370H, V370N, T371Q, T371H, T371N, V373Q, V373H, V373N, G375Q, G375H, G375N, T376Q, T376H, T376N, S377Q, S377H, S377N, T380Q, T380H, T380N, G381Q, G381H, G381N, I382Q, I382H, I382N, I383Q, I383H, I383N, S384Q, S384H, S384N, G386Q, G386H, G386N, A390Q, A390H, A390N, G393Q, G393H, G393N, G396Q, G396H, G396N, I397Q, I397H, I397N, T399Q, T399H, T399N, V401Q, V401H, V401N, S402Q, S402H, S402N, V405Q, V405H, V405N, I408Q, I408H, I408N, T412Q, T412H, T412N, T415Q, T415H, and T415N of a mature FIX polypeptide set forth in SEQ ID NO: 2 or 1035.

A modified FIX polypeptide provided herein that contains one or more amino acid modifications and exhibits increased protein stability manifested as increased protease resistance to elastase also can contain any one or more further amino acid modification at amino acid positions corresponding to positions Y1, S3, G4, K5, L6, E7, E8, F9, V10, G12, L14, E15, R16, E17, M19, E20, E21, K22; S24, F25, E26, E27, A28, R29, E30, V31, F32, E33, T35, F41, W42, K43, Y45, V46, D47, G48, D49, E52, S53, P55, L57, N58, G59, G60, K63, D64, D65, I66, Y69, W72, F75, G76, F77, E78, G79, E83, L84, V86, I90, K91, N92, G93, R94, E96, F98, K100, A103, D104, K106, V107, V108, S110, T112, E113, G114, Y115, R116, L117, A118, S123, A127, V128, P131, G133, V135, V137, S138, T140, S141, K142, L143, R145, A146, T148, V149, D152, V153, D154, Y155, V156, S158, T159, E160, A161, E162, T163, I164, L165, I168, F175, F178, T179, R180, V181, V182, G183, G184, E185, D186, A187, K188, P189, G190, F192, P193, W194, V196, V197, L198, N199, G200, K201, V202, D203, A204, F205, G207, G208, S209, I210, V211, E213, K214, W215, I216, V217, T218, A219, A220, G223, G226, V227, K228, I229, T230, V231, V232, A233, G234, E235, I238, E239, E240, E245, R248, V250, I251, R252, I253, I254, P255, Y259, A261, A262, I263, K265, Y266, D269, I270, A271, L272, L273, E274, L275, D276, E277, P278, L279, V280, L281, S283, Y284, V285, T286, P287, I288, I290, A291, D292, K293, Y295, T296, I298, F299, L300, K301, F302, G303, S304, G305, Y306, V307, S308, G309, W310, G311, R312, V313, F314, K316, G317, R318, S319, A320, L321, V322, L323, Y325, L326, R327, V328, P329, L330, V331, D332, R333, A334, T335, L337, R338, S339, T340, K341, F342, T343, I344, Y345, M348, F349, A351, G352, F353, E355, G356, G357, R358, D359, S360, G363, D364, S365, G366, G367, P368, V370, V373, E374, G375, T376, S377, F378, L379, T380, G381, I382, I383, S384, W385, G386, E387, E388, A390, M391, K392, G393, K394, Y395, G396, I397, Y398, T399, K400, V401, S402, R403, Y404, V405, W407, I408, K409, E410, K411, T412, K413, and T415 of the mature FIX polypeptide set forth in SEQ ID NO: 2 or 1035. For example, amino acid replacements at any one of the further amino acid positions can include replacements of any of Y1H, Y1I, S3Q, S3H, S3N, G4Q, G4H, G4N, K5N, K5Q, L6I, L6V, E7Q, E7H, E7N, E8Q, E8H, E8N, F9I, F9V, V10Q, V10H, V10N, G12Q, G12H, G12N, L14I, L14V, E15Q, E15H, E15N, R16H, R16Q, E17Q, E17H, E17N, M19I, M19V, E20Q, E20H, E20N, E21Q, E21H, E21N, K22N, K22Q, S24Q, S24H, S24N, F25I, F25V, E26Q, E26H, E26N, E27Q, E27H, E27N, A28Q, A28H, A28N, R29H, R29Q, E30Q, E30H, E30N, V31Q, V31H, V31N, F32I, F32V, E33Q, E33H, E33N, T35Q, T35H, T35N, T38Q, T38H, T38N, F41I, F41V, W42S, W42H, K43N, K43Q, Y45H, Y45I, V46Q, V46H, V46N, D47N, D47Q, G48Q, G48H, G48N, D49N, D49Q, E52Q, E52H, E52N, S53Q, S53H, S53N, P55A, P55S, L57I, L57V, N58Q, N58S, G59Q, G59H, G59N, G60Q, G60H, G60N, K63N, K63Q, D64N, D64Q, D65N, D65Q, I66Q, I66H, I66N, Y69H, Y69I, W72S, W72H, F75I, F75V, G76Q, G76H, G76N, F77I, F77V, E78Q, E78H, E78N, G79Q, G79H, G79N, E83Q, E83H, E83N, L84I, L84V, V86Q, V86H, V86N, I90Q, I90H, I90N, K91Q, K91N, N92Q, N92S, G93Q, G93H, G93N, R94H, R94Q, E96Q, E96H, E96N, F98I, F98V, K100N, K100Q, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L1717, L117V, A118Q, A118H, A118N, S123Q, S123H, S123N, A127Q, A127H, A127N, V128Q, V128H, V128N, P131A, P131S, G133Q, G133H, G133N, V135Q, V135H, V135N, V137Q, V137H, V137N, S138Q, S138H, S138N, T140Q, T140H, T140N, S141Q, S141H, S141N, K142N, K142Q, L143I, L143V, R145H, R145Q, A146Q, A146H, A146N, T148Q, T148H, T148N, V149Q, V149H, V149N, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, I168Q, I168H, I168N, F175I, F175V, F175H, F178I, F178V, F178H, T179Q, T179H, T179N, R180H, R180Q, V181Q, V181H, V181N, V182Q, V182H, V182N, G183Q, G183H, G183N, G184Q, G184H, G184N, E185Q, E185H, E185N, D186N, D186Q, A187Q, A187H, A187N, K188N, K188Q, P189A, P189S, G190Q, G190H, G190N, F192I, F192V, F-192H, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203N, D203Q, A204Q, A204H, A204N, F205I, F205V, G207Q, G207H, G207N, G208Q, G208H, G208N, S209Q, S209H, S209N, I210Q, I210H, I12N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, E245Q, E245H, E245N, R248H, R248Q, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, Y295H, Y295I, T296Q, T296H, T296N, I298Q, I298H, I298N, F299I, F299V, L300I, L300V, K301N, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316N, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332N, D332Q, R333H, R333Q, A334Q, A334H, A334N, T335Q, T335H, T335N, L337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351N, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, S365Q, S365H, S365N, G366Q, G366H, G366N, G367Q, G367H, G367N, P368A, P368S, V370Q, V370H, V370N, V373Q, V373H, V373N, E374Q, E374H, E374N, G375Q, G375H, G375N, T376Q, T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395H, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E410Q, E410H, E410N, K411N, K411Q, T412Q, T412H, T412N, K413N, K413Q, T415Q, T415H, and T415N of the mature FIX polypeptide set forth in SEQ ID NO: 2 or 1035.

Modified FIX polypeptides provided herein can be naked polypeptides chains or can be post-translationally modified. Exemplary post-translational modifications include glycosylation, carboxylation, hydroxylation, sulfation, phosphorylation, or conjugation to albumin or a polyethylene glycol (PEG) moiety. The modified FIX polypeptides provided herein can be further modified at one or more amino acid positions, where the modification contributes to altered immunogenicity, glycosylation, carboxylation, hydroxylation, sulfation, phosphorylation, PEGylation or protease resistance of the modified FIX polypeptide. Exemplary amino acid modifications include replacement with natural amino acids, non-natural amino acids and combinations of natural and non-natural amino acids. Such modifications can increase the stability of the FIX polypeptide.

Provided herein are any of the above modified FIX polypeptides, further containing one or more pseudo-wild type mutations. In one embodiment, the pseudo-wild-type mutations include, but are not limited to, one or more of insertions, deletions or replacements of the amino acid residue(s) of the unmodified FIX polypeptide.

Typically, the modified FIX polypeptides provided herein exhibit increased protein stability compared to the unmodified FIX polypeptide and retain one or more activities of the unmodified FIX polypeptide. Provided herein are any of the above modified FIX polypeptides exhibiting increased activity compared to the unmodified FIX. Provided herein are any of the above modified FIX polypeptides exhibiting decreased activity compared to the unmodified FIX. Activity can be assessed, for example, by measuring peptidase activity or blood coagulation in vitro or in vivo. The results of such assays correlate with an in vivo activity and hence a biological activity. In some examples the modified FIX polypeptide promotes coagulation. In other examples, the modified FIX polypeptide inhibits coagulation.

In some examples, a modified FIX polypeptide containing a modification corresponding to position F192 of a mature FIX polypeptide set forth in SEQ ID NO: 2 or 1035, and that also contains a further amino acid modification, exhibits increased protein stability and retains one or more activities of the unmodified FIX polypeptide.

Provided herein are any of the above modified FIX polypeptides, in which the increased protein stability is manifested as an increased half-life in vivo or in vitro. In one example, the increased stability is manifested as an increased half-life when administered to a subject. In another example, the modified FIX has a half-life increased by at least about or 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the half-life of unmodified FIX. In yet another example, the modified FIX also has a half-life increased by at least 1.5 times, 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times and 1000 times, or more times when compared to the half-life of unmodified FIX.

Provided herein are any of the above modified FIX polypeptides that is a precursor polypeptide containing a signal peptide and a propeptide. In one example, the signal sequence is amino acids 1-28 and the propeptide is amino acids 29-46 of the sequence of amino acids set forth in SEQ ID NO: 1. Provided herein are any of the above modified FIX polypeptides that do not have a signal peptide and/or propeptide. Modified FIX polypeptides without a signal peptide and propeptide are mature FIX polypeptides. In some cases, the modified FIX polypeptides provided herein are secreted. Such a secreted polypeptide has a signal sequence and propeptide sequence that is processed prior to secretion. Such secreted FIX polypeptides can contain other post-translational modifications, such as for example, glycosylation, carboxylation, hydroxylation, sulfation, and/or phosphorylation.

Provide herein are modified FIX polypeptides that include a heavy chain and a light chain of the FIX polypeptide. In some examples, a modified FIX polypeptide can include a heavy chain and lack a light chain. In some other examples, a modified FIX polypeptide can include a light chain and lack a heavy chain.

Provided herein are libraries (collections) of modified FIX polypeptides containing two, three, four, five, 10, 50, 100, 500, 1000, $10^3$, $10^4$ or more modified FIX polypeptides as described herein.

Provided herein are nucleic acid molecules containing a sequence of nucleotides encoding a modified FIX polypeptide as described herein. Provided herein are libraries (collections) of nucleic acid molecules comprising a plurality of the molecules as described herein.

Provided herein are vectors containing the nucleic acid molecules encoding modified FIX polypeptides as described herein. Exemplary vectors include, but are not limited to, a prokaryotic vector, a viral vector, or a eukaryotic vector. Exemplary viral vectors include adenovirus, adeno-associated-virus, retrovirus, herpes virus, lentivirus, poxvirus, and cytomegalovirus vectors. In some examples, the nucleic acid in the vector is operably linked to a promoter, such as a viral promoter or a eukaryotic promoter. Such promoters can be constitutive promoters or inducible promoters. Provided herein are libraries (collections) of such vectors containing two, three, four, five, 10, 50, 100, 500, 1000, $10^3$, $10^4$ or more vectors containing the nucleic acid molecules encoding modified FIX polypeptides as described herein.

Provided herein are cells containing nucleic acid molecules encoding modified FIX polypeptides as described herein. Provided herein are cells containing vectors that contain the nucleic acid molecules encoding modified FIX polypeptides as described herein. Such cells can be prokaryotic or eukaryotic cells, and can express the modified FIX polypeptides.

Provided herein are methods for expressing a modified FIX polypeptide. Such methods can include the steps of: i) introducing a nucleic acid encoding a modified FIX polypeptide or a vector containing a nucleic acid encoding a modified FIX into a cell, and ii) culturing the cell under conditions in which the encoded modified FIX is expressed. In one embodiment, cells are eukaryotic cells or prokaryotic cells. In one embodiment, the modified FIX polypeptide is post-translationally modified. In another method for expression of a modified FIX polypeptide, a nucleic acid molecule encoding a modified FIX or a vector containing a nucleic acid encoding a modified FIX is introduced into a cell-free translation system, whereby the encoded modified FIX polypeptide is expressed. In such expression methods above, the method can further include detection of the modified FIX polypeptide.

Provided herein are non-human transgenic animals containing an exogenous nucleic acid encoding a modified FIX polypeptide. Exemplary non-human transgenic animals include pigs, goats, sheep, rabbits, rats, and cows. Provided herein are methods of expressing modified FIX polypeptides in non-human transgenic animals and detecting the expressed modified FIX polypeptides. Modified FIX polypeptides can be isolated from tissues or fluids of the non-human transgenic animals, such as in serum, milk, or eggs. Such expressed modified FIX polypeptides can be post-translationally modified. For example, the modified FIX polypeptides can be glycosylated, carboxylated, hydroxylated, sulfated, phosphorylated, albuminated, or conjugated to a polyethylene glycol (PEG) moiety.

Provided herein are pharmaceutical compositions including any of the modified FIX polypeptides described herein. In some examples, the modified FIX polypeptides are any of amino acids set forth in SEQ ID NOS: 3-891, 917-1034, or 1036-2044.

In one example, the pharmaceutical compositions provided herein are formulated for local, systemic, or topical administration. For example the pharmaceutical compositions provided herein can be formulated for oral, nasal, pulmonary, buccal, transdermal, subcutaneous, intraduodenal, enteral, parenteral, intravenous, or intramuscular administration. In a particular example, the pharmaceutical compositions are formulated for oral administration.

Provided herein are pharmaceutical compositions of a modified FIX polypeptide, where the FIX polypeptide is modified by replacement of one or more amino acids in its primary structure to be resistant to a protease and the composition is formulated for oral administration.

Provided herein are pharmaceutical compositions of a modified FIX polypeptide, in which the modified FIX polypeptide comprises at least 1, 2, 3, 4, 5, 6, 7, 8, 9, 10, 11, 12, 13, 14, 15, 16, 17, 18, 19, or 20 modifications. Provided herein are pharmaceutical compositions of a FIX polypeptide, in which only the primary sequence of the FIX polypeptide is modified, and the polypeptide exhibits increased protein stability. Such pharmaceutical compositions of a FIX polypeptide can include removal of proteolytic digestion sites.

Provided herein are pharmaceutical compositions of a modified FIX polypeptide, in which increased protein stability is manifested as increased resistance to proteolysis. In some instances, the modified FIX polypeptide in the pharmaceutical formulation exhibits increased protein stability in the gastrointestinal tract under conditions selected from exposure to saliva, exposure to proteases in the gastrointestinal tract and exposure to low pH conditions compared to an unmodified FIX polypeptide. In some instances, the increased resistance to proteolysis occurs in serum, blood, saliva, digestive fluids or in vitro when exposed to one or more proteases. Proteases include, but are not limited to one or more of a pepsin, trypsin, chymotrypsin, elastase, aminopeptidase, gelatinase B, gelatinase A, α-chymotrypsin, carboxypeptidase, endoproteinase Arg-C, endoproteinase Asp-N, endoproteinase Glu-C, endoproteinase Lys-C, luminal pepsin, microvillar endopeptidase, dipeptidyl peptidase, enteropeptidase, hydrolase, NS3, factor Xa, Granzyme B, thrombin, plasmin, urokinase, tPA and PSA. In a particular example, that protease is elastase. In some instances, the modified FIX polypeptide in the pharmaceutical formulation exhibits increased protease resistance when it is administered orally or is present in the digestive tract.

Provided herein are pharmaceutical compositions of a modified FIX polypeptide that are a FIX naked polypeptide or a post-translationally modified polypeptide, such as a FIX polypeptide that is glycosylated, carboxylated, hydroxylated, sulfated, phosphorylated albuminated, or conjugated to a polyethylene glycol (PEG) moiety.

Provided herein are pharmaceutical compositions of a modified FIX polypeptide that further comprise one or more additional amino acid modifications that contribute to altered immunogenicity, glycosylation, carboxylation, hydroxylation, sulfation, phosphorylation, PEGylation or protease resistance of the modified FIX polypeptide. Provided herein are pharmaceutical compositions of a modified FIX polypeptide, in which one or more additional amino acid modifications are selected from natural amino acids, non-natural amino acids or a combination of natural and non-natural amino acids. Provided herein are pharmaceutical compositions of a modified FIX polypeptide, in which one or more additional amino acid modifications increase stability of the FIX polypeptide.

Provided herein are pharmaceutical compositions of a modified FIX polypeptide that further comprise one or more pseudo-wild type mutations, including insertions, deletions, and replacements of the amino acid residue(s) of the unmodified FIX polypeptide.

Provided herein are pharmaceutical compositions of a modified FIX polypeptide that exhibits increased protein stability compared to the unmodified FIX polypeptide and retains one or more activities of the unmodified FIX polypeptide. Provided herein are pharmaceutical compositions of a modified FIX polypeptide that promote coagulation. Provided herein are pharmaceutical compositions of a modified FIX polypeptide that inhibit coagulation.

Provided herein are pharmaceutical compositions of a modified FIX polypeptide in which increased protein stability of the FIX polypeptide leads to increased protein half-life of the FIX polypeptide in vivo or in vitro. Increased protein stability can lead to increased protein half-life following administration to a subject. Protein half-life can be increased in an amount of at least about or 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the half-life of the unmodified FIX polypeptide. Alternatively, protein half-life can be increased in an amount of at least 6 times, at least 7 times, at least 8 times, at least 9 times, at least 10 times, at least 20 times, at least 30 times, at least 40 times, at least 50 times, at least 60 times, at least 70 times, at least 80 times, at least 90 times, at least 100 times, at least 200 times, at least 300 times, at least 400 times, at least 500 times, at least 600 times, at least 700 times, at least 800 times, at least 900 times or at least 1000 times or more compared to an unmodified protein. In one example, the modified FIX in the pharmaceutical composition exhibits increased protein half-life or bioavailability in the gastrointestinal tract.

Provided herein are pharmaceutical compositions of a modified FIX polypeptide containing a composition that also contains a pharmaceutically acceptable carrier, diluent, or excipient. Provided herein are pharmaceutical compositions of a modified FIX polypeptide, in which the excipient is a binding agent, a filler, a lubricant, a disintegrant or a wetting agent. In a particular example, the excipient is anhydrous crystalline maltose or magnesium stearate. Provided herein are pharmaceutical compositions of a modified FIX polypeptide, in which the additive is a suspending agent, an emulsifying agent, a non-aqueous vehicle, or a preservative.

Provided herein are pharmaceutical compositions of a modified FIX polypeptide, in which the pharmaceutical composition is formulated for administration in a form selected from among liquid, a pill, a tablet, a lozenge, and a capsule. In such pharmaceutical compositions, the modified FIX polypeptide is delivered to the gastrointestinal tract or the mucosa of the mouth, throat, or gastrointestinal tract. In some pharmaceutical compositions, the pill or tablet is chewable. In another example, the pill or tablet dissolves when exposed to saliva on the tongue or in the mouth. In other pharmaceutical compositions the capsule is in liquid form. Exemplary liquid pharmaceutical compositions include a solution, a syrup, or a suspension. In some pharmaceutical compositions, the tablet or capsule is enterically coated. In some pharmaceutical compositions, the modified FIX polypeptide is formulated for controlled-release.

Provided herein are pharmaceutical compositions prepared without the use of protease inhibitors, such as a Bowman-Birk inhibitor, a conjugated Bowman-Birk inhibitor, aprotinin and camostat. Provided herein are pharmaceutical compositions formulated without protective compounds.

Provided herein are pharmaceutical compositions of nucleic acid molecules encoding any of the modified FIX polypeptides described herein or a vector containing a nucleic acid molecule encoding any of the modified FIX polypeptides described herein and a pharmaceutically acceptable excipient.

Provided herein are methods of treating a subject exhibiting symptoms of or having FIX-mediated disease or condition by administering any of the pharmaceutical compositions described herein. For example, such pharmaceutical compositions can contain modified FIX polypeptides having a sequence of amino acids set forth in any one of SEQ ID NOS: 3-891, 917-1034, or 1036-2044. In some examples, the FIX-mediated disease or condition is treated by administration of an active FIX polypeptide. In other examples the FIX-mediated disease or condition is treated by administration of an inactive FIX polypeptide. Typically, treatment with the pharmaceutical composition ameliorates or alleviates the symptoms associated with the disease or condition. Provided herein are methods of monitoring the subject for changes in the symptoms associated with the FIX-mediated disease or condition.

In one example, the FIX-mediated disease or condition includes, but is not limited to hemophilia, thrombotic disease, disseminated intravascular coagulation (DIC), or hemorrhagic disease. In such an example where the disease to be treated is hemophilia, the disease or condition can be congenital or acquired. In another example where the disease to be treated is a thrombotic disease or hemorrhagic disease, the disease or condition can be, but is not limited to, ischemia, stroke, atherosclerosis, antithrombin III deficiency, or protein C deficiency. In cases where increased coagulation is desired (i.e. for hemophilia), modified FIX polypeptides that promote blood clotting are administered. In cases where decreased coagulation is desired (i.e. for thrombotic diseases), modified FIX polypeptides that inhibit blood clotting are administered.

Provided herein are methods of treating a subject exhibiting symptoms of or having a FIX-mediated disease or condition by administering modified FIX polypeptides with additional pro-coagulation factors, such as factor VIII, factor VII, vitamin K, pro-coagulants, platelet activators, vasoconstriction agents, plasminogen inhibitors, or fibrolytic inhibitors.

Provided herein are methods of treating a subject exhibiting symptoms of or having a FIX-mediated disease or condition by administering modified FIX polypeptides with additional anticoagulation factors, such as platelet inhibitors, vasodilators, fibrolytic activators, or other anticoagulants. Exemplary anticoagulants include heparin, coumarin, and hirudin. Exemplary platelet inhibitors include aspirin, naproxen, meclofenamic acid, ibuprofen, indomethacin, phenylbutazare, and ticlopidine. Exemplary fibrolytic activators include streptokinase, urokinase, and tissue plasminogen activator (t-PA).

Provided herein are articles of manufacture including, but not limited to, packaging material and a pharmaceutical composition of a modified FIX polypeptide described herein contained within the packaging material. In a particular embodiment, the pharmaceutical composition packaged within the article of manufacture is effective for treatment of a FIX-mediated disease or disorder, and the packaging material includes a label that indicates that the modified FIX is used for treatment of a FIX-mediated disease or disorder.

Provided herein are kits including a pharmaceutical composition of a modified FIX polypeptide as described herein, a device for administration of the modified FIX polypeptide and optionally instructions for administration.

Provided herein are methods for producing a modified FIX polypeptide, having an evolved predetermined property, wherein the evolved predetermined property is increased protein stability manifested as increased protease resistance. In such examples, the increased protein stability of the FIX polypeptide that is evolved is due to amino acid modifications, such that only the primary sequence of the polypeptide is modified to confer the property. In some examples, the methods include modifications of one or more additional amino acids that contribute to altered immunogenicity, glycosylation, carboxylation, hydroxylation, sulfation, phosphorylation, or PEGylation of the modified FIX polypeptide.

In one example, a method of increasing protein stability involves the step of introducing one or more amino acid modification that leads to the removal of proteolytic digestion sites such that the polypeptide exhibits increased protease resistance where the amino acid modifications are chosen from any one or more of Y1I, S3Q, S3H, S3N, G4Q, G4H, G4N, K5N, K5Q, L6I, L6V, E7Q, E7H, E7N, E8Q, E8H, E8N, F9I, F9V, V10Q, V10H, V10N, G12Q, G12H, G12N, L14I, L14V, E15Q, E15H, E15N, R16H, R16Q, E17Q, E17H, E17N, M19I, M19V, E20Q, E20H, E20N, E21Q, E21H, E21N, K22N, K22Q, S24Q, S24H, S24N, F25I, F25V, E26Q, E26H, E26N, E27Q, E27H, E27N, A28Q, A28H, A28N, R29H, R29Q, E30Q, E30H, E30N, V31Q, V311H, V31N, F32I, F32V, E33Q, E33H, E33N, T35Q, T35H, T35N, E36Q, E36H, E36N, R37H, R37Q, T38Q, T38H, T38N, T39Q, T39H, T39N, E40Q, E40H, E40N, F41I, F41V, W42S, W42H, K43N, K43Q, Y45H, Y45I, V46Q, V46H, V46N, D47N, D47Q, G48Q, G48H, G48N, D49N, D49Q, E52Q, E52H, E52N, S53Q, S53H, S53N, P55A, P55S, L57I, L57V, N58Q, N58S, G59Q, G59H, G59N, G60Q, G60H, G60N, S61Q, S61H, S61N, K63N, K63Q, D64N, D64Q, D65N, D65Q, I66Q, I66H, I66N, S68Q, S68H, S68N, Y69H, Y69I, E70Q, E70H, E70N, W72S, W72H, P74A, P74S, F75I, F75V, G76Q, G76H, G76N, F77I, F77V, E78Q, E78H, E78N, G79Q, G79H, G79N, K80N, K80Q, E83Q, E83H, E83N, L84I, L84V, D85N, D85Q, V86Q, V86H, V86N, T87Q, T87H, T87N, I90Q, I90H, I90N, K91N, K91Q, N92Q, N92S, G93Q, G93H, G93N, R94H, R94Q, E96Q, E96H, E96N, F98I, F98V, K100N, K100Q, S102Q, S102H, S102N, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L171, L117V, A118Q, A118H, A118N, E119Q, E119H, E119N, K122N, K122Q, S123Q, S123H, S123N, E125Q, E125H, E125N, P126A, P126S, A127Q, A127H, A127N, V128Q, V128H, V128N, P129A, P129S, P131A, P131S, G133Q, G133H, G133N, R134H, R134Q, V135Q, V135H, V135N, S136Q, S136H, S136N, V137Q, V137H, V137N, S138Q, S138H, S138N, T140Q, T140H, T140N, S141Q, S141H, S141N, K142N, K142Q, L143I, L143V, T144Q, T144H, T144N, R145H, R145Q, A146Q, A146H, A146N, E147Q, E147H, E147N, T148Q, T148H, T148N, V149Q, V149H, V149N, P151A, P151S, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, D166N, D166Q, I168Q, I168H, I168N, T169Q, T169H, T169N, S171Q, S171H, S171N, T172Q, T172H, T172N, S174Q, S174H, S174N, F175I, F175V, F175H, D177N, D177Q, F178I, F178V, F178H, T179Q, T179H, T179N, R180H, R180Q, V181Q, V181H, V181N, V182Q, V182H, V182N, G183Q, G183H, G183N, G184Q, G184H, G184N, E185Q, E185H, E185N, D186N, D186Q, A187Q, A187H, A187N, K188N, K188Q, P189A, P189S, G190Q, G190H, G190N, F192I, F192V, F192IH, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203N, D203Q, A204Q, A204H, A204N, F205I, F205V, G207Q, G207H, G207N, G208Q, G208H, G208N, S209Q, S209H, S209N, I210Q, I210H, I210N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, E224Q, E224H, E224N, T225Q, T225H, T225N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, T241Q, T241H, T241N, E242Q, E242H, E242N, T244Q, T244H, T244N, E245Q, E245H, E245N, K247N, K247Q, R248H, R248Q, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, E294Q, E294H, E294N, Y295H, Y295I, T296Q, T296H, T296N, I298Q, I298H, I298N, F299I, F299V, L300I, L300V, K301N, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316H, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332N, D332Q, R333H, R333Q, A334Q, A334H, A334N, T335Q, T335H, T335N, L337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351N, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, S365Q, S365H, S365N, G366Q, G366H, G366N, G367Q, G367H, G367N, P368A, P368S, V370Q, V370H, V370N, T371Q, T371H, T371N, E372Q, E372H, E372N, V373Q, V373H, V373N, E374Q, E374H, E374N, G375Q, G375H, G375N, T376Q; T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395H, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E410Q, E410H, E410N, K411N, K411Q, T412Q, T412H, T412N, K413N, K413Q, L414I, L414V, T415 Q, T415H, and T415N of a mature FIX polypeptide set forth in SEQ ID NO: 2 or 1035.

In a particular example, a method of increasing protein stability involves the step of introducing one or more amino acid modification that leads to the removal of proteolytic digestion sites recognized by elastase such that the polypeptide exhibits increased protease resistance to elastase where the amino acid modifications are chosen from any one or more of S3Q, S3H, S3N, G4Q, G4H, G4N, V10Q, V10H, V10N, G12Q, G12H, G12N, S24Q, S24H, S24N, A28Q, A28H, A28N, V31Q, V31H, V31N, T35Q, T35H, T35N, T38Q, T38H, T38N, T39Q, T39H, T39N, V46Q, V46H, V46N, G48Q, G48H, G48N, S53Q, S53H, S53N, G59Q, G59H, G59N, G60Q, G60H, G60N, S61Q, S61H, S61N, I66Q, I66H, I66N, S68Q, S68H, S68N, G76Q, G76H, G76N, G79Q, G79H, G79N, V86Q, V86H, V86N, T87Q, T87H, T87N, I90Q, I90H, 190N, G93Q, G93H, G93N, S102Q, S102H, S102N, A103Q, A103H, A103N, V107Q, V107H, V107N, V108Q, V108H, V108N, S110Q, S110H, S110N, T112Q, T112H, T112N, G 114Q, G114H, G114N, A 118Q, A118H, A118N, S123Q, S123H, S123N, A127Q, A127H, A127N, V128Q, V128H, V128N, G133Q, G133H, G133N, V135Q, V135H, V135N, S136Q, S136H, S136N, V137Q, V137H, V137N, S138Q, S138H, S138N, T140Q, T140H, T140N, S141Q, S141H, S141N, T144Q, T144H, T144N, A146Q, A146H, A146N, T148Q, T148H, T148N, V149Q, V149H, V149N, V153Q, V153H, V153N, V156Q, V156H, V156N, S158Q, S158H, S158N, T159Q, T159H, T159N, A161Q, A161H, A161N, T163Q, T163H, T163N, I164Q, I164H, I164N, I168Q, I168H, I168N, T169Q, T169H, T169N, S171Q, S171H, S171N, T172Q, T172H, T172N, S174Q, S174H, S174N, T179Q, T179H, T179N, V181Q, V181H, V181N, V182Q, V182H, V182N, G183Q, G183H, G183N, G184Q, G184H, G184N, A187Q, A187H, A187N, G190Q, G190H, G190N, V196Q, V196H, V196N, V197Q, V197H, V197N, G200Q, G200H, G200N, V202Q, V202H, V202N, A204Q, A204H, A204N, G207Q, G207H, G207N, G208Q, G208H, G208N, S209Q, S209H, S209N, I210Q, I210H, I210N, V211Q, V211H, V211N, I216Q, I216H, I216N, V217Q, V217H, V217N, T218Q, T218H, T218N, A219Q, A219H, A219N, A220Q, A220H, A220N, V223Q, V223H, V223N, T225Q, T225H, T225N, G226Q, G226H, G226N, V227Q, V227H, V227N, I229Q, I229H, I229N, T230Q, T230H, T230N, V231Q, V231H, V231N, V232Q, V232H, V232N, A233Q, A233H, A233N, G234Q, G234H, G234N, I238Q, I238H, I238N, T241Q, T241H, T241N, T244Q, T244H, T244N, V250Q, V250H, V250N, I251Q, I251H, I251N, I253Q, I253H, I253N, I254Q, I254H, I254N, A261Q, A261H, A261N, A262Q, A262H, A262N, I263Q, I263H, I263N, I270Q, I270H, I270N, A271Q, A271H, A271N, V280Q, V280H, V280N, S283Q, S283H, S283N, V285Q, V285H, V285N, T286Q, T286H, T286N, I288Q, I288H, I288N, I290Q, I290H, I290N, A291Q, A291H, A291N, T296Q, T296H, T296N, I298Q, I298H, I298N, G303Q, G303H, G303N, S304Q, S304H, S304N, G305Q, G305H, G305N, V307Q, V307H, V307N, S308Q, S308H, S308N, G309Q, G309H, G309N, G311Q, G311H, G311N, V313Q, V313H, V313N, G317Q, G317H, G317N, S319Q, S319H, S319N, A320Q, A320H, A320N, V322Q, V322H, V322N, V328Q, V328H, V328N, V331Q, V331H, V331N, A334Q, A334H, A334N, T335Q, T335H, T335N, S339Q, S339H, S339N, T340Q, T340H, T340N, T343Q, T343H, T343N, I344Q, I344H, I344N, A351Q, A351H, A351N, G352Q, G352H, G352N, G356Q, G356H, G356N, G357Q, G357H, G357N, S360Q, S360H, S360N, G363Q, G363H, G363N, S365Q, S365H, S365N, G366Q, G366H, G366N, G367Q, G367H, G367N, V370Q, V370H, V370N, T371Q, T371H, T371N, V373Q, V373H, V373N, G375Q, G375H, G375N, T376Q, T376H, T376N, S377Q, S377H, S377N, T380Q, T380H, T380N, G381Q, G381H, G381N, I382Q, I382H, I382N, I383Q, I383H, I383N, S384Q, S384H, S384N, G386Q, G386H, G386N, A390Q, A390H, A390N, G393Q, G393H, G393N, G396Q, G396H, G396N, I397Q, I397H, I397N, T399Q, T399H, T399N, V401Q, V401H, V401N, S402Q, S402H, S402N, V405Q, V405H, V405N, I408Q, I408H, I408N, T412Q, T412H, T412N, T415Q, T415H, and T415N of a mature FIX polypeptide set forth in SEQ ID NO: 2 or 1035.

DETAILED DESCRIPTION

Outline

A. Definitions
B. Hemostasis overview
1. Clot initiation
2. Signal Amplification and the clotting cascade
3. Termination of coagulation and fibrinolysis
C. Factor IX (FIX)
1. FIX structure and function
2. FIX polypeptides
3. FIX as a biopharmaceutical
D. Exemplary methods for modifying FIX
1. Non-Restricted Rational Mutagenesis One-Dimensional (1D)-Scanning
2. Two dimensional (2D) rational scanning (restricted rational mutagenesis)
a. Identifying in-silico HITs
b. Identifying replacing amino acids
c. Construction of mutant proteins and biological assays
3. Three dimensional (3D) scanning
a. Homology
b. 3D-scanning (structural homology) methods
4. Super-LEADs and additive directional mutagenesis (ADM)
5. Multi-overlapped primer extensions
E. Modified FIX polypeptides exhibiting increased protein stability
1. Protease resistance
a. Serine Proteases
b. Matrix Metalloproteinases
c. Increased resistance to proteolysis by removal of proteolytic sites
d. Modified FIX polypeptides exhibiting increased protease resistance
i. Modified FIX polypeptides exhibiting increased protease resistance to elastase only
e. Assessment of FIX variants with increased resistance to proteolysis
2. Super-LEADs
3. Other FIX modifications
a. Immunogenicity
b. Glycosylation
c. Additional modifications
F. Production of FIX polypeptides
1. Expression systems
a. Prokaryotic expression
b. Yeast
c. Insects and insect cells
d. Mammalian cells
e. Plants
2. Purification
3. Fusion proteins
4. Polypeptide modification
5. Nucleotide sequences
G. Assessing modified FIX polypeptide properties and activities
1. In vitro assays
2. Non-human animal models
3. Clinical Assays
H. Formulation/Packaging/Administration
1. Administration of modified FIX polypeptides
a. Oral administration
2. Administration of nucleic acids encoding modified FIX polypeptides (gene therapy)
I. Therapeutic Uses
1. Hemophilia
2. Thrombotic diseases and conditions
a. Arterial thrombosis
b. Venous thrombosis and thromboembolism
i. Ischemic stroke
3. Acquired coagulation disorders
a. Disseminated intravascular coagulation (DIC)
b. Bacterial infection and periodontitis
c. Liver disease
c. Warfarin and Heparin-induced bleeding
d. Intracerebral hemorrhage
J. Combination Therapies
K. Articles of manufacture and kits
L. EXAMPLES

A. DEFINITIONS

Unless defined otherwise, all technical and scientific terms used herein have the same meaning as is commonly understood by one of skill in the art to which the invention(s) belong. All patents, patent applications, published applications and publications, GenBank sequences, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, a "factor IX" polypeptide (abbreviated herein as FIX) refers to any factor IX polypeptide, including but not limited to, a recombinantly produced polypeptide, a synthetically produced polypeptide and a factor IX polypeptide extracted or isolated from cells or tissues including, but not limited to, liver and blood. Alternative names that are used interchangeably for factor IX include Factor 9, Christmas factor, plasma thromboplastin component (PTC), coagulation factor IX, and serum factor IX. Abbreviations for factor IX include FIX and F9. Factor IX includes related polypeptides from different species including, but not limited to animals of human and non-human origin. Human factor IX (hFIX) includes factor IX, allelic variant isoforms, synthetic molecules from nucleic acids, protein isolated from human tissue and cells, and modified forms thereof. Exemplary unmodified mature human factor IX polypeptides include, but are not limited to, unmodified and wild-type native factor IX polypeptide (such as the polypeptide containing a sequence set forth in SEQ ID NO: 2) and the unmodified and wild-type precursor factor IX polypeptide that includes a propeptide and/or a signal peptide (such as, the precursor FIX polypeptide that has the sequence set forth in SEQ ID NO: 1), and a polymorphic wild-type native factor IX polypeptide that has a mutation at T148A (SEQ ID NO: 892; or its precursor containing a sequence of amino acids set forth in SEQ ID NO: 893). One of skill in the art would recognize that the referenced positions of the mature factor IX polypeptide (SEQ ID NO: 2) differ by 46 amino acid residues when compared to the precursor FIX polypeptide SEQ ID NO: 1, which is the factor IX polypeptide containing the signal peptide and propeptide sequences Thus, the first amino acid residue of SEQ ID NO: 2 "corresponds to" the forty-seventh ($47^{th}$) amino acid residue of SEQ ID NO: 1. The term "factor IX" also encompasses the active form of the factor IX polypeptide, also called factor IXa (FIXa), containing FIX light chain (SEQ ID NO: 894) and FIX heavy chain (SEQ ID NO: 896) linked by a disulfide bond between residues 132C and 289C. FIXa is produced from a mature FIX polypeptide (SEQ ID NO: 2) by proteolytic cleavage after amino acid residues R145 and R180. Proteolytic cleavage can be carried out, for example, by activated factor XI (FXIa) or the tissue factor/activated factor VII complex. The FIX polypeptides provided herein can be further modified, such as by chemical modification or post-translational modification. Such modifications include, but are not limited to, pegylation, albumination, glycosylation, farnysylation, carboxylation, hydroxylation, phosphorylation, and other polypeptide modifications known in the art.

Factor IX includes factor IX from any species, including human and non-human species. FIX polypeptides of non-human origin include, but are not limited to, murine, canine, feline, leporine, avian, bovine, ovine, porcine, equine, piscine, ranine, and other primate factor IX polypeptides. Exemplary FIX polypeptides of non-human origin include, for example, chimpanzee (*Pan troglodytes*, SEQ ID NO: 904), rhesus macaque (*Macaca mulatta*, SEQ ID NO: 912), mouse (*Mus musculus*, SEQ ID NO: 903), rat (*Rattus norvegicus*, SEQ ID NO: 907), Guinea pig (*Cavia porcellus*, SEQ ID NO: 900), pig (*Sus scrofa*, SEQ ID NO: 905), dog (*Canis familiaris*, SEQ ID NO: 899), cat (*Felis catus*, SEQ ID NO: 902), rabbit (*Oryctolagus cuniculus*, SEQ ID NO: 906), chicken (*Gallus gallus*, SEQ ID NO: 901), cow (*Bos Taurus*, SEQ ID NO: 898), sheep (*Ovis aries*, SEQ ID NO: 908), frog (*Xenopus tropicalis*, SEQ ID NO: 909), zebrafish (*Danio rerio*, SEQ ID NO: 910), Japanese pufferfish (*Takifugu rubripes*, SEQ ID NO: 911). Exemplary non-human FIX sequences that include a signal sequence and propeptide sequence include SEQ ID NOS: 899, 901-904, 909-912. Exemplary mature non-human FIX sequences that do not include a signal sequence and propeptide sequence include SEQ ID NOS: 898 and 905. Exemplary fragments of non-human FIX sequences include SEQ ID NOS: 900 and 906-908.

Human and non-human FIX polypeptides include FIX polypeptides, allelic variant isoforms, tissue-specific isoforms and allelic variants thereof, synthetic molecules prepared by translation of nucleic acids, proteins isolated from human and non-human tissue and cells, chimeric FIX polypeptides and modified forms thereof. Human and non-human FIX also include fragments or portions of FIX that are of sufficient length or include appropriate regions to retain at least one activity of the full-length mature polypeptide. Human and non-human FIX polypeptides also can include FIX polypeptides that are of sufficient length to inhibit one or more activities of a full-length mature FIX polypeptide (such as acts as an anticoagulant).

As used herein, corresponding residues refer to residues compared among or between two polypeptides that are allelic or species variants or other isoforms. One of skill in the art can readily identify residues that correspond between or among such polypeptides. For example, by aligning the sequences of factor IX polypeptides, one of skill in the art can identify corresponding residues, using conserved and identical amino acid residues as guides. For example, Y1 of SEQ ID NO: 2 (mature factor IX) corresponds to Y47 of SEQ ID NO: 1 (precursor factor IX with signal peptide and propeptide sequences). In other instances, corresponding regions can be identified. For example, the gla domain Y1 through V46 of SEQ ID NO: 2 (mature factor IX) corresponds to Y47 through V92 of SEQ ID NO: 1 (precursor factor IX with signal peptide and propeptide sequences). One skilled in the art also can employ conserved amino acid residues as guides to find corresponding amino acid residues between and among human and non-human sequences. For example, residues R145 and R180 of SEQ ID NO: 2 (human) correspond to R191 and R226 of SEQ ID NO: 904 (chimpanzee) or R192 and R236 of SEQ ID NO: 903 (mouse).

As used herein, an "active portion or fragment of a factor IX polypeptide" refers to a portion of a human or non-human FIX polypeptide that includes at least one modification provided herein and exhibits an activity, such as one or more activities of a full-length FIX polypeptide or possesses another activity. Such activities include, but are not limited to peptidase activity, any coagulant (also referred to as procoagulant) activity, anticoagulant activity or other activity. Activity can be any percentage of activity (more or less) of the full-length polypeptide, including but not limited to, 1% of the activity, 2%, 3%, 4%, 5%, 10%, 20%, 30%, 40%, 50%, 60%, 70%, 80%, 90%, 95%, 96%, 97%, 98%, 99%, 100%, 200%, 300%, 400%, 500%, or more activity compared to the full polypeptide. Assays to determine function or activity of modified forms of FIX include those known to those of skill in the art, and exemplary assays are included herein. Assays include, for example, activated partial thromboplastin time (aPTT). In one such assay, coagulation activity is measured as the time required for formation of a fibrin clot. Activity also includes activities possessed by a fragment or modified form that are not possessed by the full length polypeptide or unmodified polypeptide.

As used herein, "mature factor IX" refers to a FIX polypeptide that lacks a signal sequence and a propeptide sequence. Typically, a signal sequence targets a protein for secretion via the endoplasmic reticulum (ER)-golgi pathway and is cleaved following insertion into the ER during translation. A propeptide sequence typically functions in post-translational modification of the protein and is cleaved prior to secretion of the protein from the cell. Thus, a mature FIX polypeptide is typically a secreted protein. In one example, a mature human FIX polypeptide is set forth in SEQ ID NO: 2. The amino acid sequence set forth in SEQ ID NO: 2 differs from that of the precursor polypeptide set forth in SEQ ID NO: 1 in that SEQ ID NO: 2 is lacking the signal sequence, which includes residues 1-21 of SEQ ID NO: 1, and the propeptide sequence, which includes residues 29-46 of SEQ ID NO: 1.

As used herein, "native factor IX" refers to a FIX polypeptide encoded by a naturally occurring FIX gene that is present in an organism in nature, including a human or other animal. Included among native FIX polypeptides are the encoded precursor polypeptide, fragments thereof, and processed forms thereof, such as a mature form lacking the signal peptide as well as any pre- or post-translationally processed or modified form thereof. For example, humans express FIX. Exemplary native human FIX sequences are set forth in SEQ ID NOS: 1 (precursor FIX with a signal peptide and propeptide), 2 (mature FIX lacking a signal peptide), 893 (precursor FIX T148A allelic variant), or 892 (mature FIX T148A allelic variant). Also included among native FIX polypeptides are those that are post-translationally modified, including, but not limited to, modification by glycosylation, carboxylation, hydroxylation, sulfation, and phosphorylation. Native FIX polypeptides also include those that have been activated by proteolytic cleavage, typically at R145 or R180 of SEQ ID NO: 2. Other animals produce native FIX, and include, but are not limited to, chimpanzees, mice, rats, pigs, dogs, cats, rabbits, chickens, cows, sheep, frogs, and fish. Exemplary native FIX sequences from other animals are provided in SEQ ID NOS: 898-912.

As used herein, "activated Factor IX" or "FIXa" refers to a FIX polypeptide that has been proteolytically cleaved to activate the peptidase activity of the FIX polypeptide. Typically, proteolytic cleavage occurs at two sites in the mature FIX polypeptide, after R145 and R180 (SEQ ID NO: 2). Cleavage is typically carried out by activated factor XI (FXIa) in the presence of vitamin K. The cleavage products, FIX heavy chain and FIX light chain, which are held together by disulfide bonds, form the active FIX enzyme.

As used herein, a "zymogen" refers to any compound, such as a polypeptide, that is an inactive precursor of an enzyme and requires some change, such as proteolysis of the polypeptide, to become active. For example, FIX polypeptides exist in the blood plasma as zymogens until activation of the coagulation cascade, whereby the FIX polypeptides are cleaved by activated FXI.

As used herein, "unmodified target protein," "unmodified protein," "unmodified polypeptide," "unmodified coagulation factor," "unmodified FIX" and grammatical variations thereof refer to a starting polypeptide that is selected for modification as provided herein. The starting target polypeptide can be a naturally-occurring, wild-type form of a polypeptide. In addition, the starting target polypeptide can be altered or mutated, such that it differs from a native wild type isoform but is nonetheless referred to herein as a starting unmodified target protein relative to the subsequently modified polypeptides produced herein. Thus, existing proteins known in the art that have been modified to have a desired increase or decrease in a particular activity or property compared to an unmodified reference protein can be selected and used as the starting unmodified target protein. For example, a protein that has been modified from its native form by one or more single amino acid changes and possesses either an increase or decrease in a desired property, such as reduced immunogenicity (see such as, US-2004-0254106) or a change in an amino acid residue or residues to alter glycosylation, can be a target protein, referred to herein as unmodified, for further modification of either the same or a different property. Exemplary modified FIX polypeptides known in the art include any FIX polypeptide described in, for example, U.S. Pat. Nos. 6,277,618, 6,315,995, and 6,531,298 and U.S. Patent Publication Nos. 2004-0102388, 2004-0110675, 2004-0254106, 2005-0100982, and 2006-0040856.

Existing proteins known in the art that previously have been modified to have a desired alteration, such as an increase or decrease, in a particular biological activity or property compared to an unmodified or reference protein can be selected and used as provided herein for identification of structurally homologous loci on other structurally homologous target proteins. For example, a protein that has been modified by one or more single amino acid changes and possesses either an increase or decrease in a desired property or activity, such as for example resistance to proteolysis, can be utilized with the methods provided herein to identify on structurally homologous target proteins, corresponding structurally homologous loci that can be replaced with suitable replacing amino acids and tested for either an increase or decrease in the desired activity.

As used herein, an "activity" or a "functional activity" of a FIX polypeptide refers to any activity exhibited by a factor IX polypeptide. Such activities will depend on the form of the FIX polypeptide. For example, active FIX polypeptide typically exhibits coagulant or procoagulant activity, whereas a zymogen or other inactive form of a FIX polypeptide typically has anticoagulant activity. Activities of a FIX polypeptide can be tested in vitro and/or in vivo and include, but are not limited to, coagulation activity, anticoagulation activity, enzymatic activity, and peptidase activity. Activity can be assessed in vitro or in vivo using recognized assays, for example, by measuring coagulation in vitro or in vivo. The results of such assays that indicate that a polypeptide exhibits an activity can be correlated to activity of the polypeptide in vivo, in which in vivo activity can be referred to as biological activity. Activity can be any level of percentage of activity of the polypeptide, including but not limited to, 1% of the activity, 2%, 3%, 4%, 5%, 10%, 20%, 30%, 40%, 50%, 60%, 70%, 80%, 90%, 95%, 96%, 97%, 98%, 99%, 100%, 200%, 300%, 400%, 500%, or more of activity compared to the full polypeptide. Assays to determine functionality or activity of modified forms of FIX are known to those of skill in the art. Exemplary assays to assess the functional activity of a FIX polypeptide include activated partial thromboplastin time (aPTT) assays, and are described in Example 3.

As used herein, "exhibits at least one activity" or "retains at least one activity" refers to the activity exhibited by a modified FIX polypeptide as compared to an unmodified FIX polypeptide of the same form and under the same conditions. For example, a modified FIX polypeptide that has been activated by cleavage into its heavy and light chain form is compared with an unmodified FIX polypeptide that also has been activated by cleavage into its heavy and light chain form, under the same experimental conditions, where the only difference between the two polypeptides is the modification under study. In another example, a modified FIX polypeptide in a zymogen form is compared with an unmodified FIX polypeptide in a zymogen form, under the same experimental conditions, where the only difference between the two polypeptides is the modification under study. Generally, a modified FIX polypeptide that retains an activity of an unmodified FIX polypeptide either improves or maintains the requisite biological activity (such as, coagulation activity) of an unmodified FIX polypeptide. In some instances, a modified FIX polypeptide can retain an activity that is increased compared to an unmodified FIX polypeptide. In some cases, a modified FIX polypeptide can retain an activity that is decreased compared to an unmodified FIX polypeptide. Activity of a modified FIX polypeptide can be any level of percentage of activity of the unmodified polypeptide, including but not limited to, 1% of the activity, 2%, 3%, 4%, 5%, 10%, 20%, 30%, 40%, 50%, 60%, 70%, 80%, 90%, 95%, 96%, 97%, 98%, 99%, 100%, 200%, 300%, 400%, 500%, or more activity compared to the unmodified polypeptide. For example, a modified FIX polypeptide retains at least about or 1%, 2%, 3%, 4%, 5%, 6%, 7%, 8%, 9%, 10%, 20%, 30%, 40%, 50%, 60%, 70%, 80%, 90%, 95%, 96%, 97%, 98% or at least 99% of the activity of the wild-type FIX polypeptide. In other embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more times greater than unmodified FIX. Activity can be measured, for example, using assays such as those described in the Examples below.

As used herein, a "property" of a factor IX polypeptide refers to any property exhibited by a factor IX polypeptide. Such properties include, but are not limited to, protein stability, resistance to proteolysis, conformational stability, thermal tolerance, and tolerance to pH conditions. Changes in properties can alter an "activity" of the polypeptide.

As used herein, "protein stability" refers to increased protein-half-life under one or more conditions including, but not limited to, exposure to proteases, increased temperature, particular pH conditions and/or exposure to denaturing ingredients. Increased protein stability exhibited by a FIX polypeptide can be manifested as increased protease resistance, or increased conformational stability such as increased tolerance to temperature, pH, or tolerance to other denaturing ingredients. A modified polypeptide that exhibits increased protein stability in vitro or in vivo is, for example, 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more stable than an unmodified polypeptide. The protein stability of a polypeptide, for example, can be assessed in assays of protease resistance or conformational stability (i.e. resistance to temperature) to determine if an activity of the polypeptide is altered, such as is described in the Examples below. For example, the resistance of the modified FIX polypeptides compared to wild-type FIX against enzymatic cleavage by proteases (such as, α-chymotrypsin, carboxypeptidase, endoproteinase Arg-C, endoproteinase Asp-N, endoproteinase Glu-C, endoproteinase Lys-C, and trypsin) can be empirically tested by treating the polypeptides with proteases over time and then testing the polypeptides for residual functional activity such as for example, coagulation activities.

As used herein, "serum stability" refers to protein stability in serum.

As used herein, "resistance to proteolysis" refers to any amount of decreased cleavage of polypeptide by a proteolytic agent, such as a protease such that the resulting polypeptide exhibits a changed therapeutic property, such as increase half-life, increased bioavailability, particularly upon oral administration or other such properties. With respect to FIX polypeptides for which therapeutic activity requires activation, the proteases to which resistance is increased do not include required to activate the polypeptide, such as a protease that cleaves a zymogen into its active form. For example, FIX and modified FIX polypeptides provided herein when present in an inactive zymogen form require cleavage by factor XI (FXIa) or the tissue factor/activated factor VII complex to generate active Factor IX. Hence, reference to a FIX polypeptide that exhibits resistance to proteolysis or increased resistance to proteolysis refers to a polypeptide that exhibits resistance to one or more proteases, including, but not limited to, proteases of the gastrointestinal tract, digestive system, bloodstream, and serum, but retains the ability to be cleaved by factor XI (FXIa) or the tissue factor/activated factor VII complex Resistance to proteolysis can be achieved by modifying particular amino acid residues that are susceptible to cleavage by a particular protease to render them less susceptible to cleavage compared to cleavage by the same protease under the same conditions. A modified polypeptide that exhibits increased resistance to proteolysis exhibits, for example, 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more resistance to proteolysis than an unmodified polypeptide.

As used herein, a FIX polypeptide that is resistant to proteolysis or is resistant to protease cleavage or similar terminology, is a modified FIX polypeptide that exhibits increased resistance to a protease or proteases compared to a FIX polypeptide that does not include such modification. Modifications refer to changes in the primary amino acid sequence, unless noted otherwise.

As used herein, "conformational stability" refers to any amount of increased tolerance of a polypeptide to denaturation. This can be achieved by modifying particular amino acid residues that are susceptible to denaturation conditions to render them less susceptible to denaturation under the same conditions. Conformational stability can be determined by assessing the resistance or susceptibility of a polypeptide to denaturation conditions, such as resistance to temperature or pH. A modified polypeptide that exhibits increased conformational stability exhibits, for example, 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more resistance to denaturation than an unmodified polypeptide.

As used herein, "denaturation" refers to any noncovalent change in the structure of a protein. This change can alter the secondary, tertiary and/or quaternary structure of the polypeptide molecule. Denaturation of a polypeptide can occur by, for example but not limited to, exposure to chaotropic agents such as urea and guanidine hydrochloride, detergents, temperature, pH, and reagents which cleave disulfide bridges such as dithiothreitol or dithiothreitol.

As used herein, "thermal tolerance" refers to any temperature affected or dependent change in the stability of a protein. For example, a change, such as an increased thermal tolerance, can be reflected in a decreased amount of denaturation of a polypeptide after exposure to altered (particularly increased) temperatures compared to the unmodified protein under the same conditions. A modified polypeptide that exhibits increased thermal tolerance exhibits, for example, 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more stability at varied temperatures compared to the unmodified polypeptide. For example, a modified polypeptide can exhibit increased thermal tolerance in vivo when administered to a subject compared to an unmodified polypeptide, and thereby exhibit increased serum half-life.

As used herein, "$EC_{50}$" refers to the effective concentration of FIX necessary to give one-half of a maximum response. For purposes herein, the response measured is any activity of a FIX polypeptide, such as but not limited to, activity in a coagulation activity assay.

As used herein, "half-life" refers to the time required for a measured parameter, such the potency, activity and effective concentration of a polypeptide molecule to fall to half of its original level, such as half of its original potency, activity, or effective concentration at time zero. Thus, the parameter, such as potency, activity, or effective concentration of a polypeptide molecule is generally measured over time. For purposes herein, half-life can be measured in vitro or in vivo. For example, the half-life of FIX or a modified FIX polypeptide can be measured in vitro by assessing its activity (i.e. coagulation activity) following incubation over increasing time under certain conditions, such as for example, after exposure to proteases, or denaturing conditions such as temperature of pH. In another example, the half-life of FIX or a modified FIX polypeptide can be measured in vivo following administration (i.e. intravenous, subcutaneous, intraduodenal, oral) of the polypeptide to a human or other animal, followed by sampling of the blood over time to determine the remaining effective concentration and/or activity of the polypeptide in the blood sample.

As used herein, formulated for oral administration refers to a formulation for ingestion into the digestive system.

As used herein, mucosal delivery refers to delivery via the mucosa and, while mucosal administration can be into the mouth, its delivery does not involve the digestive system.

As used herein, "proteases," "proteinases" or "peptidases" are interchangeably used to refer to enzymes that catalyze the hydrolysis of covalent peptidic bonds. Proteases include, for example, serine proteases and matrix metalloproteinases. Serine protease or serine endopeptidases constitute a class of peptidases, which are characterized by the presence of a serine residue in the active center of the enzyme. Serine proteases participate in a wide range of functions in the body, including blood clotting, inflammation as well as digestive enzymes in prokaryotes and eukaryotes. The mechanism of cleavage by "serine proteases," is based on nucleophilic attack of a targeted peptidic bond by a serine. Cysteine, threonine, or water molecules associated with aspartate or metals also can play this role. Aligned side chains of serine, histidine, and aspartate form a catalytic triad common to most serine proteases. The active site of serine proteases is shaped as a cleft where the polypeptide substrate binds. Amino acid residues are labeled from N to C termini of a polypeptide substrate (Pi, . . . , P3, P2, P1, P1', P2', P3', . . . , Pj). The respective binding sub-sites are labeled (Si, . . . , S3, S2, S1, S1', S2', S3', . . . , Sj). The cleavage is catalyzed between P1 and P1'.

As used herein, a matrix metalloproteinases (MMP) refers to any of a family of metal-dependent, such as $Zn^{2+}$-dependent, endopeptidases that degrade components of the extracellular matrix (ECM). MMPs include four classes: collagenases, stromelysin, membrane-type metalloproteinases, and gelatinases. Proteolytic activities of MMPs and plasminogen activators, and their inhibitors, are important for maintaining the integrity of the ECM. Cell-ECM interactions influence and mediate a wide range of processes including proliferation, differentiation, adhesion, and migration of a variety of cell types. MMPs also process a number of cell-surface cytokines, receptors and other soluble proteins and are involved in tissue remodeling processes such as wound healing, pregnancy and angiogenesis. Under physiological conditions in vivo, MMPs are synthesized as inactive precursors (zymogens) and are cleaved to produce an active form. Additionally, the enzymes are specifically regulated by endogenous inhibitors called tissue inhibitors of matrix metalloproteinases (TIMPs).

As used herein, "factor IX-mediated disease or disorder" refers to any disease or disorder in which treatment with a factor IX (or modified factor IX) ameliorates any symptom or manifestation of the disease or disorder. Exemplary factor IX-mediated diseases and disorders include, but are not limited to, hemorrhagic disorders, such as hemophilia or thrombotic disorders, such as thromboembolism. Accordingly, a disease or condition that is treated by administration of FIX includes any disease or condition for which factor IX (or modified factor IX) is employed for treatment, including, but not limited to, hemorrhagic disorders, such as hemophilia or thrombotic disorders, such as thromboembolism.

As used herein, "procoagulant" refers to any substance that promotes blood coagulation.

As used herein, "anticoagulant" refers to any substance that inhibits blood coagulation.

As used herein, "hemophilia" refers to a bleeding disorder caused by or involving a deficiency in blood clotting factors. Hemophilia can be the result, for example, of absence, reduced expression, or reduced function of a clotting factor. The most common type of hemophilia is hemophilia A, which results from a deficiency in factor VIII. The second most common type of hemophilia is hemophilia B, which results from a deficiency in factor IX. Another, more rare form of hemophilia is hemophilia C, which results from a deficiency in factor XI.

As used herein, "congenital hemophilia" refers to types of hemophilia that are inherited. Congenital hemophilia results from mutation, deletion, insertion, or other modification of a clotting factor gene in which the production of the clotting factor is absent, reduced, or non-functional. For example, hereditary mutations in clotting factor genes, such as factor VIII and factor IX result in the congenital hemophilias, Hemophilia A and B, respectively.

As used herein, a "hereditary mutation" is a gene alteration that is passed from parent to offspring.

As used herein, "acquired hemophilia" refers to hemophilia that results from clotting factor deficiencies caused by conditions such as liver disease, vitamin K deficiency, or coumadin (warfarin) or other anti-coagulant therapy.

As used herein, "hemostasis" refers to the stopping of bleeding or blood flow in an organ or body part. The term hemostasis can encompass the entire process of blood clotting to prevent blood loss following blood vessel injury to subsequent dissolution of the blot clot following tissue repair.

As used herein fibrinolysis refers to the dissolution of a blood clot.

As used herein, thrombosis refers to the formation of a clot, or thrombus, inside a blood vessel, obstructing the flow of blood. The vessel can be any vein or artery as, for example, in a deep vein thrombosis or a coronary artery thrombosis.

As used herein, a thromboembolism is a clot that breaks loose and travels through the bloodstream.

As used herein, "thrombotic disease or condition" or "thrombolytic disease or disorder" are used interchangeably to refer to a disease characterized by the overproduction of blot clots. The clots can often break off and travel through the blood stream, causing damage to tissues, such as the lungs (pulmonary embolism), brain (ischemic stroke, transient ischemic attack), heart (heart attack/myocardial infarction, unstable angina), skin (purpura fulminans), and adrenal gland (hemorrhage). The clots also can cause deep vein thrombosis, low blood pressure (hypotension), and salt loss.

As used herein, "treating" a subject with a disease or condition means that the subject's symptoms are partially or totally alleviated, or remain static following treatment.

As used herein, treatment encompasses prophylaxis, therapy, and/or cure. Prophylaxis refers to prevention of a potential disease and/or a prevention of worsening of symptoms or progression of a disease. For example, treatment encompasses any pharmaceutical use of a modified factor IX and compositions provided herein.

As used herein, prevention refers to absolute prevention of a particular disease disorder. Since it generally is not possible to ascertain whether a disease or disorder never developed, prevention also includes reduction in the risk of developing or having a disease or disorder.

As used herein, a composition that does not include exogenously added proteases is a composition formulated without the addition of proteases, other than FIX or other active ingredient. Any additional proteases present in the composition would originate from the method of formulation.

As used herein, FIX is modified to be protease resistant by changes in primary structure. Among these are changes that do not result in changes in post-translational modification at that site.

As used herein, "therapeutically effective amount" or "therapeutically effective dose" refers to an agent, compound, material, or composition containing a compound that is at least sufficient to produce a therapeutic effect.

As used herein, "subject" to be treated includes humans and human or non-human animals. Mammals include, primates, such as humans, chimpanzees, gorillas and monkeys; domesticated animals, such as dogs, horses, cats, pigs, goats, cows, and rodents, such as mice, rats, hamsters and gerbils.

As used herein, a patient is a human subject.

As used herein, "a directed evolution method" refers to methods that "adapt" either proteins, including natural proteins, synthetic proteins or protein domains to have changed proportions, such as the ability to act in different or existing natural or artificial chemical or biological environments and/or to elicit new functions and/or to increase or decrease a given activity, and/or to modulate a given feature. Exemplary directed evolution methods include, among others, rational directed evolution methods described in U.S. Published Application Nos. US 2003-0134351 A1 and US-2004-0132977-A1.

As used herein, "two dimensional rational mutagenesis scanning (2-D scanning)" refers to the processes provided herein in which two dimensions of a particular protein sequence are scanned: (1) one dimension is to identify specific amino acid residues along the protein sequence to replace with different amino acids, referred to as is-HIT target positions, and (2) the second dimension is the amino acid type selected for replacing the particular is-HIT target, referred to as the replacing amino acid.

As used herein, "in silico" refers to research and experiments performed using a computer. In silico methods include, but are not limited to, molecular modeling studies and biomolecular docking experiments.

As used herein, "is-HIT" refers to an in silico identified amino acid position along a target protein sequence that has been identified based on i) the particular protein properties to be evolved, ii) the protein's sequence of amino acids, and/or iii) the known properties of the individual amino acids. These is-HIT loci on the protein sequence are identified without use of experimental biological methods. For example, once the protein feature(s) to be optimized is (are) selected, diverse sources of information or previous knowledge (i.e., protein primary, secondary or tertiary structures, literature, patents) are exploited to determine those amino acid positions that are amenable to improved protein fitness by replacement with a different amino acid. This step uses protein analysis "in silico." All possible candidate amino acid positions along a target protein's primary sequence that might be involved in the feature being evolved are referred to herein as "in silico HITs" ("is-HITs"). The collection (library), of all is-HITs identified during this step represents the first dimension (target residue position) of the two-dimensional scanning methods provided herein.

As used herein, "amenable to providing the evolved predetermined property or activity" in the context of identifying is-HITs refers to an amino acid position on a protein that is contemplated, based on in silico analysis, to possess properties or features that when replaced result in the desired activity being evolved. The phrase "amenable to providing the evolved predetermined property or activity" in the context of identifying replacement amino acids refers to a particular amino acid type that is contemplated, based on in silico analysis, to possess properties or features that when used to replace the original amino acid in the unmodified starting protein result in the evolution of a desired or preselected activity.

As used herein, "high-throughput screening" (HTS) refers to processes that test a large number of samples, such as samples of test proteins or cells containing nucleic acids encoding the proteins of interest to identify structures of interest or to identify test compounds that interact with the variant proteins or cells containing them. HTS operations are amenable to automation and are typically computerized to handle sample preparation, assay procedures, and the subsequent processing of large volumes of data.

As used herein, the term "restricted," in the context of the identification of is-HIT amino acid positions along the amino acid residues in a protein selected for amino acid replacement and/or the identification of replacing amino acids, means that fewer than all amino acids on the protein-backbone are selected for amino acid replacement and/or fewer than all of the remaining 19 amino acids available to replace the original amino acid present in the unmodified starting protein are selected for replacement. In particular embodiments of the methods provided herein, the is-HIT amino acid positions are restricted such that fewer than all amino acids on the protein-backbone are selected for amino acid replacement. In other embodiments, the replacing amino acids are restricted such that fewer than all of the remaining 19 amino acids available to replace the native amino acid present in the unmodified starting protein are selected as replacing amino acids. In an exemplary embodiment, both of the scans to identify is-HIT amino acid positions and the replacing amino acids are restricted such that fewer than all amino acids on the protein-backbone are selected for amino acid replacement and fewer than all of the remaining 19 amino acids available to replace the native amino acid are selected for replacement.

As used herein, "candidate LEADs" are mutant proteins that are designed to have an alteration in property, activity or other attribute, typically a predetermined or preselected property, activity or other attribute, such as a, chemical, physical or biological property or activity in which such alteration is sought. The alteration can add, alter, remove or otherwise change a property, activity or other attribute of a polypeptide. In the methods herein, candidate LEADs are generally generated by systematically replacing is-HITS loci in a protein or a domain thereof with typically a restricted subset, or all, of the remaining 19 amino acids, such as obtained using PAM analysis. Candidate LEADs can be generated by other methods known to those of skill in the art tested by the high throughput methods herein.

As used herein, "LEADs" are "candidate LEADs" whose property, activity or other attribute has been changed, optimized, improved, added or eliminated. For purposes herein a "LEAD" typically has activity with respect to a property or activity of interest in an unmodified polypeptide that exhibits such activity or property that differs by at least about or 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more from the unmodified and/or wild type (native) protein. In certain embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more times greater than the activity of the unmodified and/or wild type (native) protein. The desired alteration, which can be either an increase or a reduction in activity, depends upon the function or property of interest (such as, at least about or 10%, at least about or 20%, etc.). The LEADs can be further optimized by replacement of a plurality (2 or more) of "is-HIT" target positions on the same protein molecule to generate "super-LEADs."

As used herein, the term "super-LEAD" refers to protein mutants (variants) obtained by adding the single mutations present in two or more of the LEAD molecules in a single protein molecule. Accordingly, in the context of the modified proteins provided herein, the phrase "proteins comprising one or more single amino acid replacements" encompasses addition of two or more of the mutations described herein for one respective protein. For example, the modified proteins provided herein containing one or more single amino acid replacements can have any of 2, 3, 4, 5, 6, 7, 8, 9, 10, 11, 12, 13, 14, 15, 16, 17, 18, 19, 20 or more of the amino acid replacements at the disclosed replacement positions. The collection of super-LEAD mutant molecules is generated, tested, and phenotypically characterized one-by-one in addressable arrays. Super-LEAD mutant molecules are molecules containing a variable number and type of LEAD mutation. Those molecules displaying further improved fitness for the particular feature being evolved, are referred to as super-LEADs. Super-LEADs can be generated by other methods known to those of skill in the art and tested by the high throughput methods herein. For purposes herein, a super-LEAD typically has activity with respect to the function of interest that differs from the altered activity (or the new activity or eliminated activity) of a LEAD by a desired amount, such as at least about or 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more from the LEAD mutant from which it is derived. As with LEADs, the change in the activity for super-LEADs is dependent upon the activity that is being "evolved." The desired alteration, which can be either an increase or a reduction in activity, depends upon the function or property of interest. The desired alteration also can be an addition or elimination of a property or activity.

As used herein, the phrase "altered loci" refers to the is-HIT amino acid positions in the LEADs or super-LEADs that are replaced with different replacing amino acids resulting in the desired altered phenotype or activity.

As used herein, an "exposed residue" presents more than 15% of its surface exposed to the solvent.

As used herein, the phrase "structural homology" refers to the degree of coincidence in space between two or more protein backbones. Protein backbones that adopt the same protein structure, fold and show similarity upon three-dimensional structural superposition in space can be considered structurally homologous. Structural homology is not based on sequence homology, but rather on three-dimensional homology. Two amino acids in two different proteins said to be homologous based on structural homology between those proteins do not necessarily need to be in sequence-based homologous regions. For example, protein backbones that have a root mean squared (RMS) deviation of less than 3.5, 3.0, 2.5, 2.0, 1.7 or 1.5 angstroms at a given space position or defined region between each other can be considered to be structurally homologous in that region and are referred to herein as having a "high coincidence" between their backbones. It is contemplated herein that substantially equivalent (such as, "structurally related") amino acid positions that are located on two or more different protein sequences that share a certain degree of structural homology have comparable functional tasks; also referred to herein as "structurally homologous loci." These two amino acids then can be said to be "structurally similar" or "structurally related" with each other, even if their precise primary linear positions on the sequences of amino acids, when these sequences are aligned, do not match with each other. Amino acids that are "structurally related" can be far away from each other in the primary protein sequences, when these sequences are aligned following the rules of classical sequence homology.

As used herein, a "structural homolog" is a protein that is generated by structural homology. Exemplary FIX structural homologs include many other vitamin K dependent plasma proteins, including, for example, prothrombin, factor VII, factor X, and protein C.

As used herein, "variant," "factor IX variant," "modified factor IX polypeptides" and "modified factor IX proteins" refers to a FIX polypeptide that has one or more mutations compared to an unmodified factor IX polypeptide. The one or more mutations can be one or amino acid replacements, insertions or deletions and any combination thereof. Typically, a modified FIX polypeptide has one or more modifications in its primary sequence compared to an unmodified FIX polypeptide. For example, a modified FIX polypeptide provided herein can have 1, 2, 3, 4, 5, 6, 7, 8, 9, 10, 11, 12, 13, 14, 15, 16, 17, 18, 19, 20, or more mutations compared to an unmodified FIX polypeptide. Modifications that confer a property (such as, increased protein stability or increased protease resistance) by virtue of a change in a primary amino acid sequence do not require a change in post-translational modification of the modified polypeptide to confer the property. Any length polypeptide is contemplated as long as the resulting polypeptide exhibits at least one FIX activity associated with a native FIX polypeptide or inhibits an activity at least one FIX activity associated with a native FIX polypeptide (such as acts as an anticoagulant).

As used herein, a "single amino acid replacement" refers to the replacement of one amino acid by another amino acid. The replacement can be by a natural amino acid or non-natural amino acids. When one amino acid is replaced by another amino acid in a protein, the total number of amino acids in the protein is unchanged.

As used herein, the phrase "only one amino acid replacement occurs on each target protein" refers to the modification of a target protein, such that it differs from the unmodified form of the target protein by a single amino acid change. For example, in one embodiment, mutagenesis is performed by the replacement of a single amino acid residue at only one is-HIT target position on the protein backbone (such as, "one-by-one" in addressable arrays), such that each individual mutant generated is the single product of each single mutagenesis reaction. The single amino acid replacement mutagenesis reactions are repeated for each of the replacing amino acids selected at each of the is-HIT target positions. Thus, a plurality of mutant protein molecules are produced, whereby each mutant protein contains a single amino acid replacement at only one of the is-HIT target positions.

As used herein, the phrase "pseudo-wild type," in the context of single or multiple amino acid replacements, are those amino acids that, while different from the original (such as, such as native) amino acid at a given amino acid position, can replace the native one at that position without introducing any measurable change in a particular protein activity. A population (library) of sets of nucleic acid molecules encoding a collection of mutant molecules is generated and phenotypically characterized such that proteins with sequences of amino acids different from the original amino acid, but that still elicit substantially the same level (i.e., at least about or 10%, 50%, 80%, 90%, 95%, 100%, depending upon the protein) and type of desired activity as the original protein are selected. A library, contains three, four, five, 10, 50, 100, 500, 1000, $10^3$, $10^4$ or more modified FIX polypeptides.

As used herein, "in a position or positions corresponding to an amino acid position" of a protein, refers to amino acid positions that are determined to correspond to one another based on sequence and/or structural alignments with a specified reference protein. For example, in a position corresponding to an amino acid position of human FIX set forth as SEQ ID NO: 2 can be determined empirically by aligning the sequence of amino acids set forth in SEQ ID NO: 2 with a particular FIX polypeptide of interest. Corresponding positions can be determined by such alignment by one of skill in the art using manual alignments or by using the numerous alignment programs available (for example, BLASTP). Corresponding positions also can be based on structural alignments, for example by using computer simulated alignments of protein structure. Recitation that amino acids of a polypeptide correspond to amino acids in a disclosed sequence refers to amino acids identified upon alignment of the polypeptide with the disclosed sequence to maximize identity or homology (where conserved amino acids are aligned) using a standard alignment algorithm, such as the GAP algorithm.

As used herein, "at a position corresponding to" refers to a position of interest (i.e., base number or residue number) in a nucleic acid molecule or protein relative to the position in another reference nucleic acid molecule or protein. The position of interest to the position in another reference protein can be in, for example, a precursor protein, an allelic variant, a heterologous protein, an amino acid sequence from the same protein of another species, etc. Corresponding positions can be determined by comparing and aligning sequences to maximize the number of matching nucleotides or residues, for example, such that identity between the sequences is greater than 95%, 96%, 97%, 98% or 99% or more. The position of interest is then given the number assigned in the reference nucleic acid molecule.

As used herein, the terms "homology" and "identity"" are used interchangeably, but homology for proteins can include conservative amino acid changes. In general to identify corresponding positions the sequences of amino acids are aligned so that the highest order match is obtained (see, such as: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part* I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073).

As use herein, "sequence identity" refers to the number of identical amino acids (or nucleotide bases) in a comparison between a test and a reference polypeptide or polynucleotide. Homologous polypeptides refer to a pre-determined number of identical or homologous amino acid residues. Homology includes conservative amino acid substitutions as well identical residues. Sequence identity can be determined by standard alignment algorithm programs used with default gap penalties established by each supplier. Homologous nucleic acid molecules refer to a pre-determined number of identical or homologous nucleotides. Homology includes substitutions that do not change the encoded amino acid (i.e., "silent substitutions") as well identical residues. Substantially homologous nucleic acid molecules hybridize typically at moderate stringency or at high stringency all along the length of the nucleic acid or along at least about 70%, 80%, or 90% of the full-length nucleic acid molecule of interest. Also contemplated are nucleic acid molecules that contain degenerate codons in place of codons in the hybridizing nucleic acid molecule. (For determination of homology of proteins, conservative amino acids can be aligned as well as identical amino acids; in this case, percentage of identity and percentage homology vary). Whether any two nucleic acid molecules have nucleotide sequences (or any two polypeptides have amino acid sequences) that are at least 80%, 85%, 90%, 95%, 96%, 97%, 98% or 99% "identical" can be determined using known computer algorithms such as the "FASTA" program, using for example, the default parameters as in Pearson et al. (1988) *Proc. Natl. Acad. Sci. USA* 85: 2444 (other programs include the GCG program package (Devereux, J., et al. (1984) *Nucleic Acids Research* 12(I): 387), BLASTP, BLASTN, FASTA (Atschul, S. F., et al. (1990) *J. Molec. Biol.* 215:403; *Guide to Huge Computers*, Martin J. Bishop, ed., Academic Press, San Diego (1994), and Carillo et al. (1988) *SIAM J Applied Math* 48: 1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (such as, Needleman et al. (1970) *J. Mol. Biol.* 48: 443, as revised by Smith and Waterman (1981) *Adv. Appl. Math.* 2: 482. Briefly, a GAP program defines similarity as the number of aligned symbols (i.e., nucleotides or amino acids) which are similar, divided by the total number of symbols in the shorter of the two sequences. Default parameters for the GAP program can include: (1) a unary comparison matrix (containing a value of 1 for identities and 0 for non identities) and the weighted comparison matrix of Gribskov et al. (1986) *Nucl. Acids Res.* 14: 6745, as described by Schwartz and Dayhoff, eds. (1979) *Atlas of Protein Sequence and Structure*, National Biomedical Research Foundation, pp. 353-358; (2) a penalty of 3.0 for each gap and an additional 0.10 penalty for each symbol in each gap; and (3) no penalty for end gaps.

Therefore, as used herein, the term "identity" represents a comparison between a test and a reference polypeptide or polynucleotide. In one non-limiting example, "at least 90% identical to" refers to percent identities from 90 to 100% relative to the reference polypeptides. Identity at a level of 90% or more is indicative of the fact that, assuming for exemplification purposes a test and reference polynucleotide length of 100 amino acids are compared, no more than 10% (i.e., 10 out of 100) of amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, such as, 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often without relying on software.

As used herein, "corresponding structurally-related" positions on two or more polypeptides, such as FIX polypeptides and other coagulation factors, refer to those amino acid positions determined based upon structural homology to maximize tri-dimensional overlapping between or among polypeptides.

As used herein, the phrase "sequence-related proteins" refers to proteins that have at least 50%, at least 60%, at least 70%, at least 80%, at least 90%, or at least 95% amino acid sequence identity or homology with each other.

As used herein, families of non-related proteins or "sequence-non-related proteins" refer to proteins having less than 50%, less than 40%, less than 30%, less than 20% amino acid identity, or homology with each other.

As used herein, it also is understood that the terms "substantially identical" or "similar" varies with the context as understood by those skilled in the relevant art.

As used herein, "a naked polypeptide chain" refers to a polypeptide that is not post-translationally modified or otherwise chemically modified, but contains only covalently linked amino acids.

As used herein, a polypeptide complex includes polypeptides produced by chemical modification or post-translational modification. Such modifications include, but are not limited to, pegylation, albumination, glycosylation, farnsylation, carboxylation, hydroxylation, phosphorylation, and other polypeptide modifications known in the art.

As used herein, "output signal" refers to parameters that can be followed over time and, optionally, quantified. For example, when a recombinant protein is introduced into a cell, the cell containing the recombinant protein undergoes a number of changes. Any such change that can be monitored and used to assess the transformation or transfection is an output signal, and the cell is referred to as a reporter cell; the encoding nucleic acid is referred to as a reporter gene; and the construct that includes the encoding nucleic acid is a reporter construct. Output signals include, but are not limited to, enzyme activity, fluorescence, luminescence, amount of product produced, and other such signals. Output signals include expression of a gene or gene product, including heterologous genes (transgenes) inserted into the plasmid virus. Output signals are a function of time ("t") and are related to the amount of protein used in the composition. For higher concentrations of protein, the output signal can be higher or lower. For any particular concentration, the output signal increases as a function of time until a plateau is reached. Output signals also can measure the interaction between cells, expressing heterologous genes and biological agents.

As used herein, a population of sets of nucleic acid molecules encoding a collection (library) of mutants refers to a collection of plasmids or other vehicles that carry (encode) the gene variants. Thus, individual plasmids or other individual vehicles carry individual gene variants. Each element (member) of the collection is physically separated from the others in an appropriate addressable array and has been generated as the single product of an independent mutagenesis reaction. When a collection (library) of such proteins is contemplated, it will be so-stated. A library contains three, four, five, 10, 50, 100, 500, 1000, $10^3$, $10^4$ or more modified FIX polypeptides.

As used herein, a "reporter cell" is the cell that undergoes the change in response to a condition. For example, in response to exposure to a protein or a virus or to a change in its external or internal environment, the reporter cell "reports" (i.e., displays or exhibits the change).

As used herein, "reporter" or "reporter moiety" refers to any moiety that allows for the detection of a molecule of interest, such as a protein expressed by a cell. Reporter moieties include, but are not limited to, fluorescent proteins (such as, red, blue, and green fluorescent proteins), LacZ and other detectable proteins and gene products. For expression in cells, nucleic acids encoding the reporter moiety can be expressed as a fusion protein with a protein of interest or under the control of a promoter of interest.

As used herein, phenotype refers to the physical, physiological, or other manifestation of a genotype (a sequence of a gene). In methods herein, phenotypes that result from alteration of a genotype are assessed.

As used herein, culture medium is any medium suitable for supporting the viability, growth, and/or differentiation of mammalian cells ex vivo. Any such medium is known to those of skill in the art. Examples of culture medium include, but are not limited to, X-Vivo15 (BioWhittaker), RPMI 1640, DMEM, Ham's F12, McCoys 5A and Medium 199. The medium can be supplemented with additional ingredients including serum, serum proteins, growth suppressing, and growth promoting substances, such as mitogenic monoclonal antibodies and selective agents for selecting genetically engineered or modified cells.

As used herein, the amino acids that occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide comprises two or more amino acids. For purposes herein, amino acids include the twenty naturally-occurring amino acids, non-natural amino acids, and amino acid analogs (i.e., amino acids wherein the α-carbon has a side chain).

As used herein, the abbreviations for any protective groups, amino acids and other compounds are, unless indicated otherwise, in accord with their common usage, recognized abbreviations, or the IUPAC-IUB Commission on Biochemical Nomenclature (1972) *Biochem.* 11:1726). Each naturally occurring L-amino acid is identified by the standard three letter code (or single letter code) or the standard three letter code (or single letter code) with the prefix "L-;" the prefix "D-" indicates that the stereoisomeric form of the amino acid is D.

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. "$NH_2$" refers to the free amino group present at the amino terminus of a polypeptide. "COOH" refers to the free carboxy group present at the carboxyl terminus of a polypeptide. In keeping with standard polypeptide nomenclature described in (1969) *J. Biol. Chem.*, 243: 3552-3559, and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | tyrosine |
| G | Gly | glycine |
| F | Phe | phenylalanine |
| M | Met | methionine |
| A | Ala | alanine |
| S | Ser | serine |
| I | Ile | isoleucine |
| L | Leu | leucine |
| T | Thr | threonine |
| V | Val | valine |
| P | Pro | proline |
| K | Lys | lysine |
| H | His | histidine |
| Q | Gln | glutamine |
| E | Glu | glutamic acid |
| Z | Glx | Glu and/or Gln |
| W | Trp | tryptophan |
| R | Arg | arginine |
| D | Asp | aspartic acid |
| N | Asn | asparagine |
| B | Asx | Asn and/or Asp |
| C | Cys | cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, a dash at the beginning or end of an amino acid residue sequence indicates a peptide bond to a further sequence of one or more amino acid residues, to an amino-terminal group such as $NH_2$ or to a carboxyl-terminal group such as COOH.

As used herein, "naturally occurring amino acids" refer to the 20 L-amino acids that occur in polypeptides.

As used herein, the term "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally occurring amino acids and include, but are not limited to, the D-stereoisomers of amino acids. Exemplary non-natural amino acids are described herein and are known to those of skill in the art.

As used herein, nucleic acids include DNA, RNA, and analogs thereof, including protein nucleic acids (PNA) and mixtures thereof. Nucleic acids can be single- or double-stranded. When referring to probes or primers (optionally labeled with a detectable label, such as, a fluorescent or a radiolabel), single-stranded molecules are contemplated. Such molecules are typically of a length such that they are statistically unique of low copy number (typically less than 5, generally less than 3) for probing or priming a library. Generally a probe or primer contains at least 10, 15, 20, 25, or 30 contiguous nucleic acid bases of sequence complementary to, or identical to, a gene of interest. Probes and primers can be 5, 6, 7, 8, 9, 10, or more, 20 or more, 30 or more, 50 or more, 100, or more nucleic acids long.

As used herein, heterologous or foreign nucleic acid, such as DNA and RNA, are used interchangeably and refer to DNA or RNA that does not occur naturally as part of the genome in which it occurs or is found at a locus or loci in a genome that differs from that in which it occurs in nature. Heterologous nucleic acid includes nucleic acid not endogenous to the cell into which it is introduced, but that has been obtained from another cell or prepared synthetically. Generally, although not necessarily, such nucleic acid encodes RNA and proteins that are not normally produced by the cell in which it is expressed. Heterologous DNA herein encompasses any DNA or RNA that one of skill in the art recognizes or considers as heterologous or foreign to the cell or locus in or at which it is expressed. Heterologous DNA and RNA also can encode RNA or proteins that mediate or alter expression of endogenous DNA by affecting transcription, translation, or other regulatable biochemical processes. Examples of heterologous nucleic acid include, but are not limited to, nucleic acid that encodes traceable marker proteins (such as, a protein that confers drug resistance), nucleic acid that encodes therapeutically effective substances (such as, anti-cancer agents), enzymes and hormones, and DNA that encodes other types of proteins (such as, antibodies). Hence, herein heterologous DNA or foreign DNA includes a DNA molecule not present in the exact orientation and position as the counterpart DNA molecule found in the genome. It also can refer to a DNA molecule from another organism or species (i.e., exogenous).

As used herein, "isolated with reference to a nucleic acid molecule or polypeptide or other biomolecule" means that the nucleic acid or polypeptide has separated from the genetic environment from which the polypeptide or nucleic acid were obtained. It also can mean altered from the natural state. For example, a polynucleotide or a polypeptide naturally present in a living animal is not "isolated," but the same polynucleotide or polypeptide separated from the coexisting materials of its natural state is "isolated," as the term is employed herein. Thus, a polypeptide or polynucleotide produced and/or contained within a recombinant host cell is considered isolated. Also intended as an "isolated polypeptide" or an "isolated polynucleotide" are polypeptides or polynucleotides that have been partially or substantially purified from a recombinant host cell or from a native source. For example, a recombinantly produced version of a compound can be substantially purified by the one-step method described in Smith et al. (1988) *Gene*, 67:31-40. The terms isolated and purified can be used interchangeably.

Thus, by "isolated" it is meant that the nucleic acid is free of coding sequences of those genes that, in the naturally-occurring genome of the organism (if any), immediately flank the gene encoding the nucleic acid of interest. Isolated DNA can be single-stranded or double-stranded, and can be genomic DNA, cDNA, recombinant hybrid DNA or synthetic DNA. It can be identical to a starting DNA sequence or can differ from such sequence by the deletion, addition, or substitution of one or more nucleotides.

"Purified" preparations made from biological cells or hosts mean at least the purity of a cell extracts containing the indicated DNA or protein including a crude extract of the DNA or protein of interest. For example, in the case of a protein, a purified preparation can be obtained following an individual technique or a series of preparative or biochemical techniques, and the DNA or protein of interest can be present at various degrees of purity in these preparations. The procedures can include, but are not limited to, ammonium sulfate fractionation, gel filtration, ion exchange chromatography, affinity chromatography, density gradient centrifugation, and electrophoresis.

A preparation of DNA or protein that is "substantially pure" or "isolated" refers to a preparation substantially free from naturally-occurring materials with which such DNA or protein is normally associated in nature and generally contains 5% or less of the other contaminants.

A cell extract that contains the DNA or protein of interest refers to a homogenate preparation or cell-free preparation obtained from cells that express the protein or contain the DNA of interest. The term "cell extract" is intended to include culture medium, especially spent culture medium from which the cells have been removed.

As used herein, "a targeting agent" refers to any molecule that can bind another target-molecule, such as an antibody, receptor, or ligand.

As used herein, "receptor" refers to a biologically active molecule that specifically binds to (or with) other molecules. The term "receptor protein" can be used to more specifically indicate the proteinaceous nature of a specific receptor.

As used herein, "recombinant" refers to any progeny formed as the result of genetic engineering.

As used herein, a "promoter region" refers to the portion of DNA of a gene that controls transcription of the DNA to which it is operatively linked. The promoter region includes specific sequences of DNA sufficient for RNA polymerase recognition, binding, and transcription initiation. This portion of the promoter region is referred to as the "promoter". In addition, the promoter region includes sequences that modulate this recognition, binding and transcription initiation activity of the RNA polymerase. Promoters, depending upon the nature of the regulation, can be constitutive or regulated by cis acting or trans acting factors.

As used herein, the phrase "operatively linked" with reference to a nucleic acid molecule generally means the sequences or segments have been covalently joined into one piece of DNA, whether in single- or double-stranded form, whereby control or regulatory sequences on one segment control or permit expression or replication or other such control of other segments. The two segments are not necessarily contiguous. For gene expression, a DNA sequence and a regulatory sequence(s) are connected in such a way to control or permit gene expression when the appropriate molecular, such as, transcriptional activator proteins, are bound to the regulatory sequence(s).

As used herein, "production by recombinant means by using recombinant DNA methods" means the use of the well-known methods of molecular biology for expressing proteins encoded by cloned DNA, including cloning expression of genes and methods.

As used herein, a splice variant refers to a variant produced by differential processing of a primary transcript of genomic DNA that results in more than one type of mRNA.

As used herein, a composition refers to any mixture of two or more products or compounds (such as, agents, modulators, regulators, etc.). It can be a solution, a suspension, liquid, powder, a paste, aqueous, non-aqueous formulations or any combination thereof.

As used herein, a combination refers to any association between two or more items.

As used herein, an "article of manufacture" is a product that is made and sold. As used throughout this application, the term is intended to encompass pharmaceutical compositions of modified FIX polypeptides and/or nucleic acids as described herein contained in articles of packaging.

As used herein, a "kit" refers to a combination of modified FIX polypeptides or nucleic acid molecules as described herein provided in pharmaceutical compositions and another item for a purpose including, but not limited to, administration, diagnosis, and assessment of an activity or property of the polypeptides described herein. Kits, optionally, include instructions for use.

As used herein, "substantially identical to a product" means sufficiently similar so that the property of interest is sufficiently unchanged so that the substantially identical product can be used in place of the product.

As used herein, vector (or plasmid) refers to discrete elements that are used to introduce heterologous DNA into cells for either expression or replication thereof. Selection and use of such vehicles are well within the skill of the artisan. "Vector" refers to a nucleic acid molecule capable of transporting another nucleic acid to which it has been linked. One type of exemplary vector is an episome, i.e., a nucleic acid capable of extra-chromosomal replication. Exemplary vectors are those capable of autonomous replication and/or expression of nucleic acids to which they are linked; such vectors typically include origins of replication. Vectors also can be designed for integration into host chromosomes. Vectors capable of directing the expression of genes to which they are operatively linked are referred to herein as "expression vectors." Expression vectors are often in the form of "plasmids," which refer generally to circular double-stranded DNA loops which, in their vector form are not bound to the chromosome. "Plasmid" and "vector" are used interchangeably as the plasmid is the most commonly used form of vectors. Other such forms of expression vectors that serve equivalent functions and that become known in the art subsequently hereto.

As used herein, vector also includes "virus vectors" or "viral vectors." Viral vectors are engineered viruses that are operatively linked to exogenous genes to transfer (as vehicles or shuttles) the exogenous genes into cells.

As used herein, "allele," which is used interchangeably herein with "allelic variant" refers to alternative forms of a gene or portions thereof among a population. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions, and insertions of nucleotides. An allele of a gene also can be a form of a gene containing a mutation. Typically, allelic variants, have at least 80%, 90%, 95% or greater amino acid identity with a wild-type and/or predominant form from the same species.

As used herein, the terms "gene" or "recombinant gene" refer to a nucleic acid molecule containing an open reading frame and including at least one exon and, optionally, an intron-encoding sequence. A gene can be either RNA or DNA. Genes can include regions preceding and following the coding region (leader and trailer).

As used herein, "intron" refers to a DNA fragment that occurs in a gene, but that is spliced out during mRNA maturation.

As used herein, "nucleotide sequence complementary to the nucleotide sequence encoding the amino acid sequence set forth in SEQ ID NO: 1" refers to the nucleotide sequence of the complementary strand of a nucleic acid strand encoding a polypeptide that includes an amino acid sequence having the particular SEQ ID NO: 1. An exemplary nucleic acid sequence that encodes an amino acid sequence having the particular SEQ ID NO: 1 is set forth in SEQ ID NO: 897.

The term "complementary strand" is used herein interchangeably with the term "complement." The complement of a nucleic acid strand can be the complement of a coding strand or the complement of a non-coding strand. When referring to double-stranded nucleic acids, the complement of a nucleic acid encoding a polypeptide containing amino acid residues having a sequence set forth in a particular SEQ ID NO: 1 refers to the complementary strand of the strand encoding the amino acid sequence set forth in the particular SEQ ID NO: 1 or to any nucleic acid molecule containing the nucleotide sequence of the complementary strand of the particular nucleic acid sequence. When referring to a single-stranded nucleic acid molecule containing a nucleotide sequence, the complement of this nucleic acid is a nucleic acid having a nucleotide sequence which is complementary to that of the particular nucleic acid sequence.

As used herein, the term "coding sequence" refers to that portion of a gene that encodes a sequence of amino acids present in a protein.

As used herein, the term "sense strand" refers to that strand of a double-stranded nucleic acid molecule that has the sequence of the mRNA that encodes the sequence of amino acids encoded by the double-stranded nucleic acid molecule.

As used herein, the term "antisense strand" refers to that strand of a double-stranded nucleic acid molecule that is the complement of the sequence of the mRNA that encodes the sequence of amino acids encoded by the double-stranded nucleic acid molecule.

As used herein, an "array" refers to a collection of elements, such as nucleic acid molecules, containing three or more members. An addressable array is one in which the members of the array are identifiable, typically by position on a solid phase support or by virtue of an identifiable or detectable label, such as by color, fluorescence, electronic signal (i.e., RF, microwave or other frequency that does not substantially alter the interaction of the molecules of interest), bar code or other symbology, chemical or other such label. In certain embodiments, the members of the array are immobilized to discrete identifiable loci on the surface of a solid phase or directly or indirectly linked to or otherwise associated with the identifiable label, such as affixed to a microsphere or other particulate support (herein referred to as beads) and suspended in solution or spread out on a surface.

As used herein, a "support" (such as, a matrix support, a matrix, an insoluble support or solid support, etc.) refers to any solid or semisolid or insoluble support to which a molecule of interest (such as, a biological molecule, organic molecule or biospecific ligand) is linked or contacted. Such materials include any materials that are used as affinity matrices or supports for chemical and biological molecule syntheses and analyses, such as, but are not limited to: polystyrene, polycarbonate, polypropylene, nylon, glass, dextran, chitin, sand, pumice, agarose, polysaccharides, dendrimers, buckyballs, polyacrylamide, silicon, rubber, and other materials used as supports for solid phase syntheses, affinity separations and purifications, hybridization reactions, immunoassays and other such applications. The matrix herein can be particulate or can be in the form of a continuous surface, such as a microtiter dish or well, a glass slide, a silicon chip, a nitrocellulose sheet, nylon mesh, or other such materials. When particulate, typically the particles have at least one dimension in the 5-10 mm range or smaller. Such particles, referred collectively herein as "beads," are often, but not necessarily, spherical. Such reference, however, does not constrain the geometry of the matrix, which can be any shape, including random shapes, needles, fibers, and elongated. Roughly spherical "beads," particularly microspheres that can be used in the liquid phase, also are contemplated. The "beads" can include additional components, such as magnetic or paramagnetic particles (see, for example, Dynabeads (Dynal, Oslo, Norway)) for separation using magnets as long as the additional components do not interfere with the methods and analyses herein.

As used herein, matrix or support particles refer to matrix materials that are in the form of discrete particles. The particles have any shape and dimensions, but typically have at least one dimension that is 100 mm or less, 50 mm or less, 10 mm or less, 1 mm or less, 100 µm or less, 50 µm or less and typically have a size that is 100 mm$^3$ or less, 50 mm$^3$ or less, 10 mm$^3$ or less, 1 mm$^3$ or less, 100 µm$^3$ or less and can be order of cubic microns. Such particles are collectively called "beads."

As used herein, the abbreviations for any protective groups, amino acids and other compounds are, unless indicated otherwise, in accord with their common usage, recognized abbreviations, or the IUPAC-IUB Commission on Biochemical Nomenclature (1972) *Biochem.*, 11: 942-944.

B. HEMOSTASIS OVERVIEW

Provided herein are modified FIX polypeptides. These modified polypeptides have a variety of uses and applications. To appreciate the biological role of FIX polypeptides and some of their uses, an understanding of their role function in vivo is helpful. The following discussion provides such background.

The process by which the body responds to vascular injury involves a series of dependent signaling events that ultimately leads to the formation of a blot clot. Effective coagulation of blood is needed to prevent excessive blood loss at the site of injury. Once a blood vessel is injured or ruptured, vascular constriction, which limits blood flow to the area of the injury, accompanies the initial physiologic response. The rupture exposes highly thrombogenic subendothelial connective tissue that is composed of fibrillar collagen, which binds and activates platelets and stimulates platelet aggregation at the injury site. The activated platelets secrete factors which stimulate additional platelet activation, and other molecules, such as serotonin, phospholipids, and lipoproteins, which are important mediators of the clotting process. Fibrinogen, a component of the blood plasma also binds platelets and aids in clumping of the activated platelets. The activated platelets in turn undergo changes in cell shape to form a loose platelet plug. A clotting cascade of peptidases is simultaneously initiated that generates activated molecules such as thrombin (from cleavage of prothrombin), which further activates platelets, and fibrin (from cleavage of fibrinogen), which forms a cross-linked polymer around the platelet plug to stabilize the clot. During clot formation, coagulation factor inhibitors also circulate through the blood to prevent clot formation beyond the injury site.

Following repair of the injured tissue, the body must efficiently dissolve the clot in order to restore normal blood flow. Fibrinolysis is the process by which the clotting cascade is reduced and the clot is eliminated. Dissolution of the clot is mediated by the protein plasmin.

The processes of clot initiation, signal amplification, and fibrinolysis, and the factors involved are presented in further detail below.

1. Clot Initiation

Under normal conditions, vascular endothelium is resistant to clot formation. This resistance is supported by mechanisms that enhance vasodilation, inhibit platelet adhesion and activation, suppress coagulation, and promote fibrin cleavage. Vascular endothelial cells secrete molecules such as nitrous oxide (NO) and prostacylin, which inhibit platelet aggregation and dilate blood vessels. Release of these molecules activates soluble guanylate cyclases (sGC) and cGMP-dependent protein kinase I (cGKI) and increases cyclic guanosine monophosphate (cgMP) levels, which cause relaxation of the smooth muscle in the vessel wall. Furthermore, endothelial cells express cell-surface ADPases, such as CD39, which control platelet activation and aggregation by converting ADP released from platelets into adenine nucleotide platelet inhibitors. Other membrane proteins expressed on the surface of vascular endothelial cells include heparin sulfate proteoglycans that function as cofactors for antithrombin III, which inhibits thrombin and other coagulation factors. In addition, vascular endothelial cells secrete plasminogen to promote fibrinolysis, which lyses and clears clots.

Upon blood vessel injury, the damaged vessel wall exposes the subendothelial connective tissue to the circulating blood. In contrast to normal endothelial cells, this tissue is extremely thrombogenic. The layer is composed of proteins such as von Willebrand factor (vWF) and fibrillar collagen, which bind to circulating platelets via glycoprotein receptors expressed on the surface of the platelets. The platelet glycoprotein receptor complex GPIb-V-IX binds vWF, whereby vWF can bridge the platelets to the collagen fibrils. vWF is a multimeric glycoprotein, which contributes to its ability to aggregate platelets. vWF also functions to stabilize coagulation factors, such as factor VIII, and promotes their survival in the blood stream. Furthermore, the platelet integrin receptors $\alpha_2\beta_1$ and GPVI can bind to collagen directly. Binding of collagen to $\alpha_2\beta_1$ can facilitate binding to the lower affinity GPVI receptor. The collagen interactions with $\alpha_2\beta_1$ and GPVI contribute to platelet adherence to the site of injury and furthermore promote platelet activation through activation of intracellular signaling cascades.

2. Signal Amplification and the Clotting Cascade

During clot formation, positive feedback loops are activated that enhance the maturation of a clot. Following platelet activation, expression of the platelet surface integrin $\alpha_{IIb}\beta_3$ is stimulated. $\alpha_{IIb}\beta_3$ can bind to vWF and fibrinogen. Binding of GPIb-V-IX to vWF can enhance the affinity of $\alpha_{IIb}\beta_3$ for vWF to promote platelet adhesion. Further, one fibrinogen molecule can bind to multiple $\alpha_{IIb}\beta_3$ integrin molecules from different cells, thus, enhancing platelet aggregation.

Platelet activation stimulates the release of platelet alpha and dense granules. The released contents of the granules include factors, such as vWF and ADP, which further contribute to aggregation and platelet activation. ADP helps stimulate modification of the platelet membrane that allows binding of fibrinogen to $\alpha_{IIb}\beta_3$, and vWF contributes to adhesion and aggregation as discussed above.

In addition to ADP, activated platelets also secrete factors such as serotonin and thromboxane $A_2$ (TXA$_2$) which also positively regulate platelet activation. Signal transduction cascades activated in response to thrombin binding control release of these factors. During platelet activation, thrombin binds to a G-protein coupled receptor on the surface of platelets. The receptor becomes stimulated, and the activated G-protein activates phospholipase C-γ 2 (PLCγ2), which hydrolyzes phosphatidylinositol 4,5-bisphosphate (PIP$_2$) to generate inositol triphosphate (IP$_3$) and diacylglycerol (DAG). IP$_3$ stimulates release of intracellular calcium (Ca$^{2+}$) stores from the endoplasmic reticulum by binding to IP$_3$ receptors. The released calcium in combination with collagen binding to platelets leads to the activation of phospholipase A2 (PLA$_2$). PLA$_2$ then hydrolyzes membrane phospholipids, such as phosphatidylcholine (PC) and phosphatidylethanolamine (PE), to generate arachidonic acid, which in turn stimulates the production and release of TXA$_2$.

The production of DAG by activated platelets stimulates protein kinase C, which then phosphorylates a platelet specific 47 kDa protein (p47). The phosphorylated p47 protein induces the release of the platelet granules as discussed above. Intracellular Ca$^{2+}$ release also activates myosin-light chain kinase (MLCK) that phosphorylates the light chain of myosin. The phosphorylated myosin then interacts with actin, bringing about a change in platelet morphology and motility, necessary for clot formation.

Platelet activation through collagen binding also elicits activation of a similar signaling cascade. When collagen binds to the GPVI integrin, it promotes clustering of GPVI with the Fc receptor γ-chain (FcγR). The clustering induces tyrosine phosphorylation of the FcγR by Src-family kinases Lyn and Fyn, which promote binding and activation of the tyrosine kinase Syk. Syk, in turn phosphorylates the transmembrane adapter protein LAT, which then assembles a signaling complex composed of proteins including phosphoinositide 3-kinase (PI3K), PLCγ2, adaptor proteins such as Gads, SLP-75, and SLAP-130, and the RhoGTP exchange factor Vav. PI3K can then regulate protein kinase B (PKB), phosphoinositide-dependent kinase (PDK1) and integrin-linked kinase (ILK), which can regulate integrin expression and signaling. PLCγ2 generates IP$_3$ and DAG to mobilize calcium and activate PKC as described above.

For stable clot formation, cross-linked fibrin polymers must be formed surrounding the activated platelet plug. Fibrin formation is generated though activation of coagulation factor cascades which occurs simultaneously with platelet activation, following vessel injury. Two converging pathways can be activated, the intrinsic and extrinsic pathway. Key factors that participate in the intrinsic and extrinsic coagulation cascades are listed in Tables 2 and 3. The high-molecular weight kininogen, prekallikrein, and factors XII, XI, IX, and VIII participate in the intrinsic pathway, while tissue factor and the factor VII complex contribute to the extrinsic pathway. The two pathways converge at the activation of factor X (to generate FXa), through proteolytic action of the activated factor IX (FIXa)/factor VIII (FVIIIa) tenase complex (intrinsic) or by the activated factor VII (FVIIa)/tissue factor (TF) complex (extrinsic). Activated factor X (FXa), with the help of factor V, calcium, and platelet phospholipid, generates thrombin from prothrombin. In turn, thrombin cleaves fibrinogen to produce fibrin and also activates factor XIII (transglutamidase), which cross-links fibrin polymers to form the stable clot. The surface of activated platelets facilitates the formation of the activated coagulation factor complexes and thus participates in amplification of the cascade.

The primary pathway for initiation is the extrinsic pathway; the intrinsic pathway functions to amplify the production of activated factor X. Following vascular injury, tissue factor (TF) in the vessel wall is exposed and generated. TF is expressed by endothelial cells, subendothelial tissue, and monocytes. When the vessel wall is disrupted TF produced by the subendothelial layer is exposed. In the case of endothelial cell damage in the absence of a vessel wall lesion, contact is made between the blood and TF expressed on the damaged endothelial layer in the cell wall. vWF aids in the interaction of platelets with the damaged endothelium. TF binds to VII and in turn catalyzes the activation of factor X. The thrombin that is generated by the extrinsic pathway then contributes to activation of factor XI of the intrinsic cascade, leading to the activation of factor IX. Factor IX also can be activated directly by the TF/factor VII complex. The intrinsic cascade also can be activated via factor XII-mediated activation of factor XI when prekallikrein is converted to kallikrein in response to collagen contact with the vessel surface (called the contact pathway), though this pathway plays a minimal role in coagulation as compared to the amplification effects of thrombin. The contact pathway plays a more important role in fibrinolysis since factor XII and kallikrein can convert plasminogen into plasmin and bradykinin, which is a potent vasodilator and stimulator for tissue plasminogen activator (tPA).

3. Termination of Coagulation and Fibrinolysis

During coagulation constitutive and stimulated processes inhibit further clot formation. Antithrombin III and tissue factor pathway inhibitor (TFPI) work constitutively to inhibit factors in the coagulation cascade. Specifically, antithrombin III inhibits thrombin, FIXa, and FXa, where as TFPI inhibits FXa and FVIIa/TF complex. Protein C, which is stimulated via platelet activation, proteolytically inactivates FVa and FVIIIa. Further, another factor which contributes to coagulation inhibition is the integral membrane protein thrombomodulin, which is produced by vascular endothelial cells and binds thrombin. Complex formation inhibits thrombin procoagulant activities and also contributes to protein C activation.

Clearance of the fibrin clot is carried out by the serine protease plasmin, which can digest fibrin. Prior to activation of this enzyme, it circulates in the blood in the form of the proenzyme plasminogen. Plasminogen can bind to fibrin and fibrinogen, which allows it to be incorporated into the clot as it is formed. Cleavage of plasminogen into active plasmin is primarily carried out by activated tPA, which is secreted by endothelial cells following injury, through stimulation of tPA activity. Production of plasmin also can be initiated and enhanced by the actions of factor XII as discussed above.

TABLE 2

Coagulation Factors

| Factor | Common Name | Pathway | Characteristic |
|---|---|---|---|
| I | Fibrinogen | Both | — |
| II | Prothrombin | Both | Contains N-terminal gla segment |
| III | Tissue Factor | Extrinsic | — |
| IV | Calcium | Both | — |
| V | Proaccelerin, labile factor, Accelerator globulin | Both | Protein cofactor |
| VI (Va) | Accelerin | — | (Redundant to factor V) |
| VII | Proconvertin, serum prothrombin conversion accelerator (SPCA) cothromboplastin | Extrinsic | Endopeptidase with gla residues |
| VIII | Antihemophiliac factor A, antihemophiliac globulin (AHG) | Intrinsic | Protein cofactor |
| IX | Christmas factor, antihemophiliac factor B, plasma thromboplastin component (PTC) | Intrinsic | Endopeptidase with gla residues |
| X | Stuart-prower factor | Both | Endopeptidase with gla residues |
| XI | Plasma thromboplastin antecedent (PTA) | Intrinsic | Endopeptidase |
| XII | Hageman factor | Intrinsic | Endopeptidase |

TABLE 2-continued

Coagulation Factors

| Factor | Common Name | Pathway | Characteristic |
|---|---|---|---|
| XIII | Protransglutamidase, fibrin stabilizing factor (FSF), fibrinoligase | Both | Transpeptidase |

*Table adapted from M. W. King (2006) med.unibs.it/~marchesi/blood.html

TABLE 3

Coagulation Factor Zymogens and Cofactors

| Name of Factor | Activity |
|---|---|
| Zymogens of Serine Proteases | |
| Factor XII | Binds exposed collagen at site of vessel wall injury, activated by high-MW kininogen and kallikrein |
| Factor XI | Activated by factor XIIa |
| Factor IX | Activated by factor XIa + $Ca^{2+}$ |
| Factor VII | Activated by thrombin + $Ca^{2+}$ |
| Factor X | Activated on platelet surface by tenase complex; Also activated by factor VIIa + tissue factor + $Ca^{2+}$ |
| Factor II | Activated on platelet surface by prothrombinase complex; |
| Cofactors | |
| Factor VIII | Activated by thrombin; factor VIIa acts as cofactor for factor IXa in activation of factor X |
| Factor V | Activated by thrombin; factor Va acts as cofactor for factor Xa in activation of prothrombin |
| Factor III (Tissue factor) | Acts as cofactor for factor VII Fibrinogen |
| Factor I | Cleaved by thrombin to form fibrin Transglutaminase |
| Factor XIII | Activated by thrombin + $Ca^{2+}$; promotes covalent cross-linking of fibrin |
| Regulatory and other proteins | |
| von Willebrand factor (vWF) | Acts as bridge between GPIb-V-IX complex and collagen |
| Protein C | Activated by thrombin bound to thrombomodulin; Ca degrades factors VIIIa and Va |
| Protein S | Acts as cofactor of protein C |
| Thrombomodulin | Endothelial cell surface protein; binds thrombin, which activates protein C |
| Antithrombin III | Coagulation inhibitor of thrombin, and factors IXa, Xa, XIa, and XIIa. |

*Table adapted from M. W. King (2006) med.unibs.it/~marchesi/blood.html

C. FACTOR IX (FIX)

Coagulation Factor IX (FIX) is a vitamin-K dependent serine protease produced in animals, including mammals, that plays a pivotal role in the blood clotting cascade that functions to seal injured blood vessels. FIX shows a high degree of homology to other vitamin-K dependent serine proteases, including factor VII, factor X, and protein C (Furie et al., 1988). FIX is synthesized in the liver as an inactive zymogen that is secreted into the blood stream. During the coagulation process, FIX is cleaved via the intrinsic pathway by active factor XIa to generate an active serine protease, FIXa. FIXa also is generated via the extrinsic pathway by factor VIIa/tissue factor (FVIIa/TF). FIXa binds to activated Factor VIII (FVIIIa) and catalyzes the conversion of factor X to its active form, factor Xa, which hydrolyzes prothrombin into active thrombin Coagulation factors, including FIX, are used as therapeutic agents. Treatment with recombinant FIX is an established therapy. Recombinant FIX is used, for example, as a therapeutic for treatment of diseases such as hemophilia, in particular, hemophilia B. Patients receiving FIX are subject to frequent, repeated applications of the drug due to instability of FIX in the blood stream and under storage conditions. Hence, improved FIX stability (half-life) in serum or following oral administration and/or in in vitro applications can improve its activity and efficiency as a drug. Accordingly, provided herein are modified FIX polypeptides that display improved protein stability, such as by increased resistance to proteases, resulting in increased protein half-life. The modified polypeptides can possess increased stability in the bloodstream or following oral administration (in vivo) and/or under storage conditions (in vitro).

1. Factor IX Structure and Function

The human coagulation FIX gene is located on chromosome X at Xq27.1 and contains 8 exons of varying length from 25 base pairs to about 2000 base pairs. The mRNA for FIX is about 3 kilobases in length, comprising 205 bases of 5' UTR (untranslated region), 1386 bases encoding the FIX polypeptide, and 1392 bases of 3' UTR. The FIX mRNA encodes for a 461 amino acid precursor FIX polypeptide. The nucleotide coding sequence and the encoded precursor polypeptide are provided in SEQ ID NOS: 897 and 1, respectively.

The precursor FIX polypeptide comprises the following segments and domains: a hydrophobic signal peptide (aa 1-28 of SEQ ID NO: 1), a propeptide (aa 29-46 of SEQ ID NO: 1), a gla domain (aa 47-92 of SEQ ID NO: 1), a type B epidermal growth factor domain (FGF-like 1, aa 93-129 of SEQ ID NO: 1), a type A epidermal growth factor domain (EGF-like 2, aa 130-171 of SEQ ID NO: 1), an activation peptide (aa 192-226 of SEQ ID NO: 1), and a serine protease domain (aa 227-461 of SEQ ID NO: 1). The mature form of the FIX polypeptide lacks the signal peptide and propeptide sequences (SEQ ID NO: 2). In the mature form of the FIX polypeptide the corresponding amino acid positions for the above mentioned domains are as follows: gla domain (aa 1-46 of SEQ ID NO: 2), EGF-like 1 (aa 47-83 of SEQ ID NO: 2), EGF-like 2 (aa 84-125 of SEQ ID NO: 2), activation peptide (aa 146-180 of SEQ ID NO: 2), and serine protease domain (aa 181-415 of SEQ ID NO: 2). Amino acid positions for FIX polypeptides provided herein are given with respect to the mature form of the FIX polypeptide (SEQ ID NO: 2), unless otherwise noted.

The signal peptide at the N-terminus of the precursor FIX polypeptide (SEQ IS NO: 1) is 28 amino acids in length and functions to target the FIX polypeptide to the cellular secretory pathway by insertion into the endoplasmic reticulum (ER) during translation. The signal sequence is cleaved by a signal peptidase within the ER lumen. Once inside the ER lumen, the FIX polypeptide is post-translationally modified by N-linked and O-linked glycosylation, β-hydroxylation, and γ-carboxylation. β-hydroxylation and γ-carboxylation are completed in the ER, while glycosylation commences in the ER and finishes in the Golgi complex.

The propeptide, which is 18 amino acids in length, provides a binding site for a vitamin K-dependent carboxylase. The recognition element for the carboxylase is located in the N-terminal portion of the propeptide, which forms a 10 residue amphipathic α-helix. After binding, the carboxylase γ-carboxylates 12 glutamic acid residues within the gla domain of the FIX polypeptide, producing γ-carboxy-glutamyl residues at positions E53, E54, E61, E63, E66, E67, E72, E73, E76, E79, E82, and E86 relative to the FIX precursor amino acid sequence set forth in SEQ ID NO: 1. These positions correspond to positions E7, E8, E15, E17, E20, E21, E26, E27, E30, E33, E36, and E40 relative to the mature FIX polypeptide set forth in SEQ ID NO: 2. The γ-carboxyglutamyl modifications aid in the correct folding of the mature FIX polypeptide and in the ability to FIX to bind calcium ($Ca^{2+}$) and phospholipids. γ-Carboxyglutamyl residues located at amino acid positions 17, 21, and 27, relative to the mature FIX polypeptide (SEQ ID NO: 2), form ion pairs with the amino terminal alanine in prothrombin, which stabilize the structure of the gla domain and promote interaction with phospholipid membranes (Soriano-Garcia et al. (1992) *Biochemistry* 31:2554-2566). The C-terminal end of the gla domain also contains a conserved hydrophobic domain containing a Phe-Trp-X-X-Tyr motif, located at amino acid positions 41-45 relative to the mature FIX polypeptide (SEQ ID NO: 2), which is required for $Ca^{2+}$ dependent changes in protein structure and for formation of a membrane binding site with the gla domain. In addition, proper folding of the gla domain enables binding of cofactor FVIIIa to FIXa, in order to form the complex which catalyzes the conversion of factor X into its active form, FXa. With respect to the other post-translational modifications of FIX, β-hydroxylation occurs at D64 to form p-hydroxyaspartic acid, N-linked glycosylation at N157 and N167, O-linked glycosylation at S53, S61, T159, T169, T172, and T179; sulfation at Y155; and phosphorylation of S68 and S158, relative to the mature FIX polypeptide, SEQ ID NO: 2 (Furie et al. (1988) *Cell* 53:505-518 and Kaufman et al. (1998) *Thromb. Haemost.* 79:1068-1079).

After post-translation modification and prior to secretion, the propeptide is cleaved by a propeptidase to generate the mature FIX polypeptide, which is 415 amino acids in length (SEQ ID NO: 2). The recognition element for binding of the propeptidase is proposed to be located on the carboxyl side of the propeptide, closer to the site of cleavage. PACE/furin is a subtilisin-like calcium-dependent serine propeptidase localized to the trans Golgi compartment that has the ability to cleave the FIX propeptide into its mature form (Wasley et al. (1993) *J Biol Chem.* 268(12):8458-65). The name PACE is an acronym for Paired basic Amino acid Cleaving Enzyme, which describes the characteristic of the enzyme to cleave after a pair of basic amino acids, namely K45-R46 in FIX (positions relative to precursor FIX polypeptide as set forth in SEQ ID NO: 1; K-2 and R-1 relative to the mature FIX polypeptide set forth in SEQ ID NO: 2). The consensus motif for PACE cleavage is Arg-X-(Lys/Arg)-Arg. PACE/furin also functions to process the propeptides of other proteins, such as pro-von Willebrand factor, pro-nerve growth factor proalbumin, and complement pro-C3. PACE/furin is ubiquitously expressed and is likely to process additional proteins, including growth factors, receptors, and other coagulation factors. Other members of the PACE family of peptidases include PC1/3, PC2, PACE4, PC4, PC5/6 and PC7/SPC7/LPC/PC8, though functional and expression data suggest that PACE/furin is most likely the FIX propeptidase in vivo. Mutation of the tyrosine residue at position 1 of the mature FIX polypeptide (Y47 in the precursor FIX polypeptide) has been shown to increase the efficiency of cleavage of the propeptide sequence (Meulian et al. (1990) *Protein Eng.* 3(7):629-33).

The first EGF-like domain (EGF-like 1, EGF1) is a type B EGF domain and contains the β-hydroxylation site at D64. β-Hydroxylation aids in the binding of additional $Ca^{2+}$, which promotes binding of cofactor VIII to the domain. Two Q-linked glycosylation sites are located within this domain at S53 and S61 (relative to the mature FIX polypeptide, SEQ ID NO: 2).

The second EGF-like domain (EGF-like 2, EGF2) is a type A EGF domain, which lacks β-hydroxylated residues compared to the type B domain. The EGF2 domain is responsible for binding to platelets and for assembly of the factor X activating complex (Wilkinson et al. (2002) *J. Biol. Chem.*, 277(8):5734-5741). Formation of this complex on the surface of activated platelets promotes efficient hydrolysis of factor X.

The activation peptide contains the two cleavage sites, R145-A146 and R180-V181 (relative to mature FIX polypeptide, SEQ ID NO: 2) which are hydrolyzed by FXIa in the presence of $Ca^{2+}$, or by FVIIa in the presence of TF, phospholipid, and $Ca^{2+}$ to generate the activated form, FIXa. The activation peptide also contains two of the N-linked glycosylation sites at N157 and N167 and four of the O-linked glycosylation sites at T159, T169, T172, and T179. Upon cleavage, the activation peptide (SEQ ID NO: 895) is excised from the polypeptide, leaving the activated FIX polypeptide, containing of a light chain and a heavy chain that are attached via cysteine disulfide bonds. The light chain includes the amino terminal portion of the FIX polypeptide, comprising the gla, EGF1, and EGF2 domains (SEQ ID NO: 894). The heavy chain comprises the FIX serine protease domain (SEQ ID NO: 896).

The serine protease domain is a catalytic domain that is homologous to known serine proteases, such as chymotrypsin, and contains an analogous catalytic core of residues at H221, D269, and S365 (relative to the mature FIX polypeptide, SEQ ID NO: 2). The protease domain catalyzes the hydrolysis of factor X in the presence of $Ca^{2+}$, phospholipids, and FVIIIa by cleaving the R53-I53 bond of mature factor X.

2. Factor IX Polypeptides

Factor IX (FIX) polypeptides are heterogeneous polypeptides, are made of varying amino acid sequence lengths and include, but are not limited to, recombinantly produced polypeptide, synthetically produced polypeptide and FIX extracted from cells as tissues such as, for example, liver. FIX includes related polypeptides from different species including, but not limited to, animals of human and non-human origin, allelic variant isoforms, species isoforms, synthetic molecules from nucleic acids, protein isolated from human tissue and cells, and modified forms thereof. Exemplary unmodified mature FIX polypeptides include, but are not limited to, unmodified and wild-type native FIX polypeptide (such as the polypeptide containing a sequence set forth in SEQ ID NO: 2), the unmodified and wild-type precursor FIX polypeptide that includes a signal peptide and a propeptide (such as the polypeptide that has the sequence set forth in SEQ ID NO: 1), a polymorphic wild-type variant of native factor IX polypeptide that has alanine at amino acid position T148 (SEQ ID NO: 892; or its precursor containing a sequence of amino acids set forth in SEQ ID NO: 893), and chimeric variants of FIX polypeptides such as set forth in SEQ ID NO: 1035. Unmodified FIX polypeptides also include FIX polypeptides that are modified by the cellular machinery and include, for example, glycosylation, carboxylation, β-hydroxylation, sulfation, and phosphorylation.

Based on alignment of FIX with other coagulation factor family members, such as factor VII (FVII) or factor X (FX), homologous domains among the family members are readily identified. Chimeric variants of FIX polypeptides can be constructed where one or more amino acids or entire domains are replaced in the FIX amino acid sequence using the amino acid sequence of the corresponding family member. Such chimeric proteins can be used as the unmodified FIX polypeptide for the methods described herein. For example, amino acid residues of the gla domain can be replaced with residues from the analogous FVII or FX gla domains (Lin et al. (1990) *J. Biol. Chem.* 265(1):144-150 and Cheung et al. (1991) *J. Biol. Chem.* 266(14):8797-880). A chimeric FIX protein can then be further modified by amino acid replacement for increased protein stability using any the methods described herein. Exemplary modified chimeric FIX polypeptides have amino acid sequences set forth in SEQ ID NOS: 1036-2044.

FIX is functionally active following cleavage by FXIa in the presence of $Ca^{2+}$ or by FVIIa in the presence of TF, phospholipid, and $Ca^{2+}$. Hydrolysis of mature FIX polypeptides generates heavy and light chains of FIX that are connected by disulfide bridges. FIX polypeptides therefore also include FIX heavy chain and FIX light chain polypeptides (SEQ ID NOS: 896 and 894, respectively) and combinations thereof.

The full structure of coagulation FIX is formed from six FIX molecules. Modified polypeptides can be stabilized by intra-(within FIX polypeptide) and inter-(between heavy and light chains of FIX polypeptide or between subunits) subunit interactions. Amino acids within the helices of each FIX polypeptide chain can interact with each other, thereby contributing to protein stability within a FIX polypeptide (i.e., "intrastability"). For example, cysteine residues form disulfide bonds between the FIX heavy and light polypeptide chains. In addition, interhelical contacts occur between helices of different subunits thereby contributing to protein stability between the monomers (i.e., "interstability"). For example, amino acid residues in helices on monomer A can interact with amino acid residues in helices on monomer B.

Contemplated herein are modified FIX polypeptides that differ from unmodified or wild-type FIX polypeptides with respect to a property or an activity. Modified FIX polypeptides provided herein can have increased stability, as manifested as increased serum half-life or increased resistance to proteases as compared to unmodified FIX polypeptides.

Generally, FIX is produced as a larger polypeptide (461 aa, SEQ ID NO: 1, for example) that is matured to a smaller polypeptide upon cleavage of the signal sequence (amino acids 1-28 of SEQ ID NO: 1, for example). FIX polypeptides are typically about 433 amino acids in length after cleavage of the signal sequence, and typically about 415 amino acids in length following further cleavage of the propeptide sequence, resulting in a mature FIX polypeptide (SEQ ID NO: 2, for example).

FIX is a secreted, glycosylated protein, including O- and N-linked glycosylation sites. The extent of glycosylation of the FIX polypeptides provided herein can contribute to the stability of the protein and to protease resistance. Glycosylation of FIX polypeptides provided herein also can contribute to the amount of protein expression, secretion, and potency of the FIX polypeptide. FIX polypeptides provided herein can be γ-carboxylated, β-hydroxylated, tyrosine sulfated, and/or phosphorylated.

FIX polypeptides from different species share conserved sequences of amino acids (see, for example, mouse, rat, guinea pig, cow, sheep, dog, cat, chicken, pig, rabbit, fish, and chimpanzee FIX polypeptides). Such sequences can be used for modification using the methods described herein.

Active and inactive forms of FIX polypeptides are known in the art. Active peptidase forms of FIX can be used in the treatment of hemophilias, where FIX polypeptides can function to promote blood coagulation. FIX polypeptides that have an inactive protease domain can be used in the treatment of thrombotic diseases by inhibiting blood coagulation via interference of the coagulation cascade.

Modes of administration include, but are not limited to, FIX polypeptide injection or the nucleic acid molecules encoding modified FIX polypeptides provided herein and also can include additional treatments administered similarly or through other routes of administration, including oral administration and inhalation, stem cell engraftment, and systemic administration of viral vectors encoding a FIX polypeptide. FIX also can be targeted for delivery into specific cell types. For example, adenoviral vectors encoding FIX polypeptides can be used for stable expression in nondividing cells, such as liver cells, and skeletal muscle cells (Arruda et al. (2001) *Blood* 97(1): 130-138 and Yao et al. (1992) *PNAS* 89: 3357-3361). In another example, viral or nonviral vectors encoding FIX polypeptides can be transduced into isolated cells for subsequent delivery. Additional cell types for expression and delivery of FIX are known in the art and include but are not limited to, fibroblasts and endothelial cells (Palmer et al. (1989) *Blood* 73: 438-445; Yao et al. (1991) *PNAS* 88: 810I-8105).

3. FIX as a Pharmaceutical

Activities induced by FIX include, but are not limited to, blood coagulation. Administration of FIX has been shown to promote blood clotting in patients suffering from hemophilia, particularly hemophilia B. In man, treatment with doses of FIX have been found to be safe and well-tolerated.

FIX can be administered orally, systemically, buccally, transdermally, intravenously, intramuscularly and subcutaneously and, typically, multiple administrations are used in treatment regimens. The formulations are typically stored in refrigerated (2-8° C.) conditions to ensure retention of activity. Hence, improved FIX stability (half-life) in administered conditions (in vivo), such as stability in serum, and in vitro (such as, during production, purification and storage conditions) can improve its utility and efficiency as a drug.

Provided herein are variants of the FIX polypeptide that display improved stability as assessed by resistance to proteases (blood, intestinal, etc) and/or increased thermal tolerance and/or pH conditions, wherein the mutant variants exhibit increased protein half-life. The mutant variants that exhibit improved stability possess increased stability in administration conditions such as in the bloodstream, gastrointestinal tract, under low pH conditions (such as, the stomach), mouth, throat, and/or under storage conditions.

D. EXEMPLARY METHODS FOR MODIFYING FIX

Provided herein are methods for increasing stability and half-life of a FIX polypeptide by increasing resistance to proteolysis. Provided herein are methods of modifying FIX polypeptides to increase resistance to proteolysis by proteases (blood, serum, gastrointestinal, etc.), whereby the modified polypeptide exhibits increased half-life in vitro and/or in vivo. Provided herein are modified FIX polypeptides in which the primary amino acid sequence is modified to confer increased protein stability. Among the amino acid modifications provided herein are such modifications including replacement of amino acids in the primary sequence of the FIX polypeptide in order to decrease proteolytic cleavage of the FIX polypeptide. Further modifications of the modified FIX polypeptide can be included, such as, but not limited to, addition of carbohydrate, phosphate, sulfur, hydroxyl, carboxyl, and polyethylene glycol (PEG) moieties. Thus, the modified FIX polypeptides provided herein can be further modified, for example, by glycosylation, phosphorylation, sulfation, hydroxylation, carboxylation, and/or PEGylation. Such modifications can be performed in vivo or in vitro.

Provided herein are methods of modifying polypeptides to increase resistance to proteolysis by proteases and contacting proteolytic enzymes with peptide inhibitors, thereby inhibiting activity of the proteases. Also provided herein are the modified polypeptides generated by said methods. Provided herein are FIX polypeptides that display improved stability as assessed by resistance to proteases; the modified FIX polypeptides exhibiting these properties possess, thereby, increased protein half-life in vitro or in vivo.

The modified FIX polypeptides (also referred to herein as variants) are more stable compared to unmodified FIX polypeptides. Increasing stability (i.e., the half-life of proteins in vivo) can result in a decrease in the frequency of injections needed to maintain a sufficient drug level in serum, thus leading to: i) higher comfort to, and acceptance by, treated subjects, particularly human subjects, ii) lower doses necessary to achieve comparable biological effects, and iii) as a consequence, an attenuation of the (dose-dependent) secondary effects.

Increased stability of FIX can be achieved, for example, by destruction of protease target residues or sequences and/or by modification of residues that contribute to conformational stability and are susceptible to denaturation by temperature, pH, or other denaturing agent. Modification of FIX to increase stability can be accomplished while keeping activity unchanged compared to the unmodified or wild-type FIX. Alternatively, modification of FIX stability can be accomplished while increasing activity compared to the unmodified or wild-type FIX. Any methods known in the art can be used to create modified FIX polypeptides. In the methods described herein, modifications are chosen using the method of 2D-scanning mutagenesis as described, for example, in PCT published applications WO 2004/022747 and WO 2004/022593.

In principle, there are several general approaches described for protein-directed evolution based on mutagenesis. Any of these, alone or in combination can be used to modify a FIX polypeptide to achieve increased stability and/or resistance to proteolysis. Such methods include random mutagenesis, where the amino acids in the starting protein sequence are replaced by all (or a group) of the 20 amino acids either in single or multiple replacements at different amino acid positions are generated on the same molecule, at the same time. Another method, restricted random mutagenesis, introduces either all of the 20 amino acids or DNA-biased residues. The bias is based on the sequence of the DNA and not on that of the protein in a stochastic or semi-stochastic manner, respectively, within restricted or predefined regions of the protein known in advance to be involved in the activity being "evolved." Additionally, methods of rational mutagenesis including 1D-scanning, 2D-scanning, and 3D-scanning can be used alone or in combination to construct modified FIX variants.

1. Non-Restricted Rational Mutagenesis One-Dimensional (1D)-Scanning

Rational mutagenesis, also termed 1D-scanning, is a two-step process, and is described in co-pending U.S. application Ser. No. 10/022,249 (U.S. Publication No. 2003/0134351-A1). 1D-scanning can be used to modify FIX polypeptides and, additionally, to identify positions for further modification by other methods such as 2D- and 3D-scanning. Briefly, in the first step, full-length amino acid scanning is performed where all and each amino acid in the starting FIX polypeptide sequence (for example SEQ ID NO: 2) is replaced by a designated reference amino acid (such as, alanine). Only a single amino acid is replaced on each protein molecule at a time. A collection of protein molecules having a single amino acid replacement is generated such that molecules differ from each other by the amino acid position at which the replacement has taken place. Mutant DNA molecules are designed, generated by mutagenesis and cloned individually, such as in addressable arrays, such that they are physically separated from each other and such that each one is the single product of an independent mutagenesis reaction. Mutant protein molecules derived from the collection of mutant nucleic acid molecules also are physically separated from each other, such as by formatting in addressable arrays. Activity assessment on each protein molecule allows for the identification of those amino acid positions that result in a drop in activity when replaced, thus indicating the involvement of that particular amino acid position in the protein's biological activity and/or conformation that leads to fitness of the particular feature being evolved. Those amino acid positions are referred to as HITs.

At the second step, a new collection of molecules is generated such that each molecule differs from each of the others by the amino acid present at the individual HIT positions identified in step 1. All 20 amino acids (19 remaining) are introduced at each of the HIT positions identified in step 1; while each individual molecule contains, in principle, one and only one amino acid replacement. Mutant DNA molecules are designed, generated by mutagenesis and cloned individually, such as in addressable arrays, such that they are physically separated from each other and such that each one is the single product of an independent mutagenesis reaction. Mutant protein molecules derived from the collection of mutant DNA molecules also are physically separated from each other, such as by formatting in addressable arrays. Activity assessment then is individually performed on each individual mutant molecule. The newly generated mutants that lead to a desired alteration (such as an improvement) in a protein activity are referred to as LEADs. This method permits an indirect search for property or activity alteration, such as improved stability and/or improved resistance to proteases or thermal conditions based on one rational amino acid replacement and sequence change at a single amino acid position at a time, in search of a new, unpredicted amino acid sequence at some unpredicted regions along a protein to produce a protein that exhibits a desired activity or altered activity, such as better performance than the starting protein.

In this approach, neither the amino acid position nor the replacing amino acid type are restricted. Full length protein scanning is performed during the first step to identify HIT positions, and then all 20 amino acids are tested at each of the HIT positions, to identify LEAD sequences; while, as a starting point, only one amino acid at a time is replaced on each molecule. The selection of the target region (HITs and surrounding amino acids) for the second step is based upon experimental data on activity obtained in the first step. Thus, no prior knowledge of protein structure and/or function is necessary. Using this approach, LEAD sequences have been found on proteins that are located at regions of the protein not previously known to be involved in the particular biological activity being modified; thus emphasizing the power of this approach to discover unpredictable regions (HITs) as targets for fitness improvement.

2. Two Dimensional (2D) Rational Scanning (Restricted Rational Mutagenesis)

The 2D-scanning (or restricted rational mutagenesis) methods for protein rational evolution (see, co-pending U.S. Published Application Nos. US 2005-0202438 A1 and US-2004-0132977-A1 and published International applications WO 2004/022593 and WO 2004/022747) are based on scanning over two dimensions. The first dimension is the amino acid position along the protein sequence, in order to identify is-HIT target positions. The second dimension is scanning the amino acid type selected for replacing a particular is-HIT amino acid position. An advantage of the 2D-scanning methods provided herein is that at least one, and typically the amino acid position and/or the replacing amino acid, can be restricted such that fewer than all amino acids on the protein-backbone are selected for amino acid replacement; and/or fewer than all of the remaining 19 amino acids available to replace an original, such as native, amino acid are selected for replacement.

In particular embodiments, based on i) the particular protein properties to be evolved (such as, resistance to proteolysis), ii) sequence of amino acids of the protein, and iii) the known properties of the individual amino acids, a number of target positions along the protein sequence are selected, in silico, as "is-HIT target positions." This number of is-HIT target positions is as large as reasonably possible such that all reasonably possible target positions for the particular feature being evolved are included. In particular, embodiments where a restricted number of is-HIT target positions are selected for replacement, the amino acids selected to replace the is-HIT target positions on the particular protein being optimized can be either all of the remaining 19 amino acids or, more frequently, a more restricted group comprising selected amino acids that are contemplated to have the desired effect on protein activity. In another embodiment, so long as a restricted number of replacing amino acids are used, all of the amino acid positions along the protein backbone can be selected as is-HIT target positions for amino acid replacement. Mutagenesis then is performed by the replacement of single amino acid residues at specific is-HIT target positions on the protein backbone (such as, "one-by-one," such as in addressable arrays), such that each individual mutant generated is the single product of each single mutagenesis reaction. Mutant DNA molecules are designed, generated by mutagenesis and cloned individually, such as in addressable arrays, such that they are physically separated from each other and that each one is the single product of an independent mutagenesis reaction. Mutant protein molecules derived from the collection of mutant DNA molecules also are physically separated from each other, such as by formatting in addressable arrays. Thus, a plurality of mutant protein molecules is produced. Each mutant protein contains a single amino acid replacement at only one of the is-HIT target positions. Activity assessment is then individually performed on each individual protein mutant molecule, following protein expression and measurement of the appropriate activity. An example of practice of this method is shown in the Examples in which mutant FIX molecules are produced.

The newly generated proteins that lead to altered, typically improved, target protein activity are referred to as LEADs. This method relies on an indirect search for protein improvement for a particular activity (such as increased resistance to proteolysis), based on amino acid replacement and sequence change at single or, in another embodiment, a limited number of amino acid positions at a time. As a result, optimized proteins, which have modified sequences of amino acids at some regions along the protein that perform better (at a particular target activity or other property) than or different from the starting protein, are identified and isolated.

2D-scanning on FIX was used to generate variants improved in protein stability, including improved resistance to proteolysis. To effect such modifications, amino acid positions were selected using in silico analysis of FIX.

a. Identifying in-Silico HITs

The 2D-scanning method for directed evolution of proteins includes identifying and selecting (using in silico analysis) specific amino acids and amino acid positions (referred to herein as is-HITs) along the protein sequence that are contemplated to be directly or indirectly involved in the feature being evolved. As noted, the 2D-scanning methods provided include the following two steps. The first step is an in silico search of a target sequence of amino acids of the protein to identify all possible amino acid positions that can be targets for the activity being evolved. This is effected, for example, by assessing the effect of amino acid residues on the property or properties to be altered on the protein, using any known standard software. The particulars of the in silico analysis is a function of the property to be modified.

Once identified, these amino acid positions or target sequences are referred to as "is-HITs" (in silico HITs). In silico HITs are defined as those amino acid positions (or target positions) that potentially are involved in the "evolving" feature, such as increased resistance to proteolysis. The discrimination of the is-HITs among all the amino acid positions in a protein sequence can be made based on the amino acid type at each position in addition to the information on the protein secondary or tertiary structure. In silico HITs constitute a collection of mutant molecules such that all possible amino acids, amino acid positions or target sequences potentially involved in the evolving feature are represented. No strong theoretical discrimination among amino acids or amino acid positions is made at this stage. In silico HIT positions are spread over the full length of the protein sequence. Single or a limited number of is-HIT amino acids are replaced at a time on the target FIX polypeptide.

A variety of parameters can be analyzed to determine whether or not a particular amino acid on a protein might be involved in the evolving feature, typically a limited number of initial premises (typically no more than 2) are used to determine the in silico HITs. For example, as described herein, to increase the stability of FIX, the first condition is the nature of the amino acids linked to stability of the molecule such as its participation in directing proteolytic cleavage. A second premise, for example, can be related to the specific position of those amino acids along the protein structure.

During the first step of identification of is-HITs according to the methods provided herein, each individual amino acid along the protein sequence is considered individually to assess whether it is a candidate for is-HIT. This search is done one-by-one and the decision on whether the amino acid is considered to be a candidate for a is-HIT is based on (1) the amino acid type; (2) the position in the protein and protein structure if known; and (3) the predicted interaction between that amino acid and its neighbors in sequence and space.

Is-HITs were identified for a number of properties of FIX that contribute to protein stability, such as removal/modification of protease sensitive sites. Such modifications contribute to protein stability and thereby, to increasing the half-life of a FIX polypeptide in vitro, in vivo or ex vivo.

b. Identifying Replacing Amino Acids

Once the is-HITs target positions are selected, the next step is identifying those amino acids that will replace the original, such as native, amino acid at each is-HIT position to alter the activity level for the particular feature being evolved. The set of replacing amino acids to be used to replace the original, such as native, amino acid at each is-HIT position can be different and specific for the particular is-HIT position. The choice of the replacing amino acids takes into account the need to preserve the physicochemical properties such as hydrophobicity, charge and polarity of essential (such as, catalytic, binding, etc.) residues and alter some other property of the protein (such as, protein stability). The number of replacing amino acids of the remaining 19 non-native (or non-original) amino acids that can be used to replace a particular is-HIT target position ranges from 1 up to about 19, and anywhere in between, depending on the properties for the particular modification.

Numerous methods of selecting replacing amino acids (also referred to herein as "replacement amino acids") are well known in the art. Protein chemists determined that certain amino acid substitutions commonly occur in related proteins from different species. As the protein still functions with these substitutions, the substituted amino acids are compatible with protein structure and function. Often, these substitutions are to a chemically similar amino acid, but other types of changes, although relatively rare, also can occur.

Knowing the types of changes that are most and least common in a large number of proteins can assist with predicting alignments and amino acid substitutions for any set of protein sequences. Amino acid substitution matrices are used for this purpose. A number of matrices are available. A detailed presentation of such matrices can be found in the co-pending U.S. Published Application Nos. US 2005-0202438 A1 and US-2004-0132977-A1 and published International applications WO 2004/022593 and WO 2004/022747, each of which is incorporated herein in their entirety herein. Such matrices also are known and available in the art, for example in the reference listed below.

In amino acid substitution matrices, amino acids are listed horizontally and vertically, and each matrix position is filled with a score that reflects how often one amino acid would have been paired with the other in an alignment of related protein sequences. The probability of changing amino acid "A" into amino acid "B" is assumed to be identical to the reverse probability of changing "B" into "A". This assumption is made because, for any two sequences, the ancestor amino acid in the phylogenetic tree is usually not known. Additionally, the likelihood of replacement should depend on the product of the frequency of occurrence of the two amino acids and on their chemical and physical similarities. A prediction of this model is that amino acid frequencies will not change over evolutionary time (Dayhoff et al., *Atlas of Protein Sequence and Structure*, 5(3): 345-352, 1978). Several exemplary amino acid substitution matrices, including, but not limited to block substitution matrix (BLOSUM) (Henikoff et al. (1992) *Proc. Natl. Acad. Sci. USA*, 89: 10915-10919), Jones et al. (1992) *Comput. Appl. Biosci.*, 8: 275-282, Gonnet et al. (1992) *Science*, 256: 1433-1445, Fitch (1966) *J. Mol. Evol.*, 16(1): 9-16, Feng et al. (1985) *J. Mol. Evol.*, 21: 112-125, McLachlan (1971) *J. Mol. Biol.*, 61: 409-424, Grantham (1974) *Science*, 185: 862-864, Miyata (1979) *J. Mol. Evol.*, 12: 219-236, Rao (1987) *J. Pept. Protein Res.*, 29: 276-281, Risler (1988) *J. Mol. Biol.*, 204: 1019-1029, Johnson et al. (1993) *J. Mol. Biol.*, 233: 716-738, and Point Accepted Mutation (PAM) (Dayhoff et al. (1978) *Atlas of Protein Sequence and Structure* 5: 345-352.

Dayhoff and coworkers developed a model of protein evolution that resulted in the development of a set of widely used replacement matrices (Dayhoff et al., (1978) *Atlas of Protein Sequence and Structure* 5(3):345-352) termed percent accepted mutation matrices (PAM). In deriving these matrices, each change in the current amino acid at a particular site is assumed to be independent of previous mutational events at that site. Thus, the probability of change of any amino acid A to amino acid B is the same, regardless of the previous changes at that site and also regardless of the position of amino acid A in a protein sequence.

In the Dayhoff approach, replacement rates are derived from alignments of protein sequences that are at least 85% identical; this constraint ensures that the likelihood of a particular mutation being the result of a set of successive mutations is low. Because these changes are observed in closely related proteins, they represent amino acid substitutions that do not significantly change the function of the protein. Hence, they are called "accepted mutations," as defined as amino acid changes that are accepted by natural selection.

The outcome of the two steps set forth above, which is performed in silico is that: (1) the amino acid positions that are the target for mutagenesis are identified (referred to as is-HITs); and (2) the replacing amino acids for the original, such as native, amino acids at the is-HITs are identified, to provide a collection of candidate LEAD mutant molecules that are expected to perform differently from the native molecule. These are assayed for a desired optimized (or improved or altered) activity.

c. Construction of Modified Proteins and Biological Assays

Once is-HITs are selected as set forth above, replacing amino acids are introduced. Mutant proteins typically are prepared using recombinant DNA methods and assessed in appropriate biological assays for the particular activity (feature) optimized. An exemplary method of preparing the mutant proteins is by mutagenesis of the original, such as native, gene using methods well known in the art. Mutant molecules are generated one-by-one, such as in addressable arrays, such that each individual mutant generated is the single product of each single and independent mutagenesis reaction. Individual mutagenesis reactions are conducted separately, such as in addressable arrays where they are physically separated from each other. Once a population of sets of nucleic acid molecules encoding the respective mutant proteins is prepared, each is separately introduced one-by-one into appropriate cells for the production of the corresponding mutant proteins. This also can be performed, for example, in addressable arrays where each set of nucleic acid molecules encoding a respective mutant protein is introduced into cells confined to a discrete location, such as in a well of a multi-well microtiter plate. Each individual mutant protein is individually phenotypically characterized and performance is quantitatively assessed using assays appropriate for the feature being optimized (i.e., feature being evolved). Again, this step can be performed in addressable arrays. Those mutants displaying a desired increased or decreased performance compared to the original, such as native molecules are identified and designated LEADs. From the beginning of the process of generating the mutant DNA molecules up through the readout and analysis of the performance results, each candidate LEAD mutant is generated, produced and analyzed individually, such as from its own address in an addressable array. The process is amenable to automation.

3. Three Dimensional (3D) Scanning 3D scanning, as described in co-pending U.S. Published Application Nos. US 2005-0202438 A1 and US-2004-0132977-A1 and published PCT applications WO 2004/022747 and WO 2004/022593, is an additional method of rational evolution of proteins based on the identification of potential target sites for mutagenesis (is-HITs). The method uses comparison of patterns of protein backbone folding between structurally related proteins, irrespective of the underlying sequences of the compared proteins. Once the structurally related amino acid positions are identified on the protein of interest, then suitable amino acid replacement criteria, such as PAM analysis, can be employed to identify candidate LEADs for construction and screening.

For example, analysis of "structural homology" between and among a number of related vitamin K-dependent proteases can be used to identify on various members of the vitamin K-dependent protease family, those amino acid positions and residues that are structurally similar or structurally related. For example, 3D scanning can be used to identify amino acid positions on FIX that are structurally similar or structurally related to those found in factor VII mutants, for example, that have been modified for improved stability. Exemplary vitamin K-dependent proteases include, but are not limited to, prothrombin, factor VII, factor X and protein C.

Using the 3D-scanning methods described herein, once one protein within a family of proteins (such as, FIX within the vitamin-K dependent protease family) is modified using the methods provided herein for generating LEAD mutants, is-HITs can be identified for other or all proteins within a particular family by identifying the corresponding amino acid positions therein using structural homology analysis (based upon comparisons of the 3D structures of the family members with original protein to identify corresponding residues for replacement) as described hereinafter. The is-HITs for the family members identified in this manner then can be subjected to the next step of identifying replacing amino acids and further assayed to obtain LEADs or super-LEADs as described herein. Similarly, information from 2D-scanning performed on other vitamin K-dependent proteases such as prothrombin, factor VII, factor X or protein C, for example, can be used to optimize FIX polypeptides.

This method can be applied to any desired phenotype using any protein, such as a vitamin K-dependent protease, as the starting material to which an evolution procedure, such as the rational directed evolution procedure of U.S. Published Application No. US 2003-0134351 A1 or the 2-dimensional scanning method described herein. The structurally corresponding residues are then altered on members of the family to produce additional vitamin K-dependent proteases with similar phenotypic alterations.

a. Homology

Typically, homology between proteins is compared at the level of their amino acid sequences, based on the percent or level of coincidence of individual amino acids, amino acid per amino acid, when sequences are aligned starting from a reference, generally the residue encoded by the start codon. For example, two proteins are said to be "homologous" or to bear some degree of homology whenever their respective amino acid sequences show a certain degree of matching upon alignment comparison. Comparative molecular biology is primarily based on this approach. From the degree of homology or coincidence between amino acid sequences, conclusions can be made on the evolutionary distance between or among two or more protein sequences and biological systems.

The concept of "convergent evolution" is applied to describe the phenomena by which phylogenetically-unrelated organisms or biological systems have evolved to share features related to their anatomy, physiology and structure as a response to common forces, constraints and evolutionary demands from the surrounding environment and living organisms. Alternatively, "divergent evolution," is applied to describe the phenomena by which strongly phylogenetically related organisms or biological systems have evolved to diverge from identity or similarity as a response to divergent forces, constraints and evolutionary demands from the surrounding environment and living organisms.

In the typical traditional analysis of homologous proteins there are two conceptual biases corresponding to: i) "convergent evolution," and ii) "divergent evolution." Whenever the aligned amino acid sequences of two proteins do not match well with each other, these proteins are considered "not related" or "less related" with each other and have different phylogenetic origins. There is no (or low) homology between these proteins and their respective genes are not homologous (or show little homology). If these two "non-homologous" proteins under study share some common functional features (such as, interaction with other specific molecules, activity), they are determined to have arisen by "convergent evolution," i.e., by evolution of their non-homologous amino acid sequences, in such a way that they end up generating functionally "related" structures.

On the other hand, whenever the aligned amino acid sequences of two proteins do match with each other to a certain degree, these proteins are considered to be "related" and to share a common phylogenetic origin. A given degree of homology is assigned between these two proteins and their respective genes likewise share a corresponding degree of homology. During the evolution of their initial highly homologous amino acid sequence, enough changes can be accumulated in such a way that they end up generating "less-related" sequences and less related function. The divergence from perfect matching between these two "homologous" proteins under study is said come from "divergent evolution."

b. 3D-Scanning (Structural Homology) Methods

Structural homology refers to homology between the topology and three-dimensional structure of two proteins. Structural homology is not necessarily related to "convergent evolution" or to "divergent evolution," nor is it related to the underlying amino acid sequence. Rather, structural homology is likely driven (through natural evolution) by the need of a protein to fit specific conformational demands imposed by its environment. Particular structurally homologous "spots" or "loci" would not be allowed to structurally diverge from the original structure, even when its own underlying sequence does diverge. This structural homology is exploited herein to identify loci for mutation.

Within the amino acid sequence of a protein resides the appropriate biochemical and structural signals to achieve a specific spatial folding in either an independent or a chaperon-assisted manner. Indeed, this specific spatial folding ultimately determines protein traits and activity. Proteins interact with other proteins and molecules in general through their specific topologies and spatial conformations. In principle, these interactions are not based solely on the precise amino acid sequence underlying the involved topology or conformation. If protein traits, activity (behavior and phenotypes) and interactions rely on protein topology and conformation, then evolutionary forces and constraints acting on proteins can be expected to act on topology and conformation. Proteins sharing similar functions will share comparable characteristics in their topology and conformation, despite the underlying amino acid sequences that create those topologies and conformations.

4. Super-Leads and Additive Directional Mutagenesis (ADM)

Modification of FIX polypeptides also can include combining two or more mutations. For example, Additive Directional Mutagenesis (ADM) can be used to assemble on a single mutant protein multiple mutations present on the individual LEAD molecules, so as to generate super-LEAD mutant proteins (see co-pending U.S. Published Application Nos. US 2005-0202438 A1 and US-2004-0132977-A1 and published PCT applications WO 2004/022747 and WO 2004/022593). ADM is a repetitive multi-step process where at each step after the creation of the first LEAD mutant protein a new LEAD mutation is added onto the previous LEAD mutant protein to create successive super-LEAD mutant proteins. ADM is not based on genetic recombination mechanisms, nor on shuffling methodologies; instead it is a simple one-mutation-at-a-time process, repeated as many times as necessary until the total number of desired mutations is introduced on the same molecule. To avoid the exponentially increasing number of all possible combinations that can be generated by putting together on the same molecule a given number of single mutations, a method is provided herein that, although it does not cover all the combinatorial possible space, still captures a big part of the combinatorial potential. "Combinatorial" is used herein in its mathematical meaning (i.e., subsets of a group of elements, containing some of the elements in any possible order) and not in the molecular biological or directed evolution meaning (i.e., generating pools, or mixtures, or collections of molecules by randomly mixing their constitutive elements).

A population of sets of nucleic acid molecules encoding a collection of new super-LEAD mutant molecules is generated tested and phenotypically characterized one-by-one in addressable arrays. Super-LEAD mutant molecules are such that each molecule contains a variable number and type of LEAD mutations. Those molecules displaying further improved fitness for the particular feature being evolved are referred to as super-LEADs. Super-LEADs can be generated by other methods known to those of skill in the art and tested by the high throughput methods herein. For purposes herein a super-LEAD typically has activity with respect to the function or biological activity of interest that differs from the improved activity of a LEAD by a desired amount, such as at least about or 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more from at least one of the LEAD mutants from which it is derived. In yet other embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more greater than at least one of the LEAD molecules from which it is derived. As with LEADs, the change in the activity for super-LEADs is dependent upon the property that is being "evolved." The desired alteration, which can be either an increase or a reduction in a feature or property, will depend upon the function or property of interest.

In one embodiment, the ADM method employs a number of repetitive steps, such that at each step a new mutation is added on a given molecule. Although numerous different ways are possible for combining each LEAD mutation onto a super-LEAD protein, an exemplary way the new mutations (such as, mutation 1 (ml), mutation 2 (m2), mutation 3 (m3), mutation 4 (m4), mutation 5 (m5), mutation n (mn)) can be added corresponds to the following diagram:

m1
m1+m2
m1+m2+m3
m1+m2+m3+m4
m1+m2+m3+m4+m5
m1+m2+m3+m4+m5+ . . . +mn
m1+m2+m4
m1+m2+m4+m5
m1+m2+m4+m5+ . . . +mn
m1+m2+m5
m1+m2+m5+ . . . +mn
m2
m2+m3
m2+m3+m4 m2+m3+m4+m5
m2+m3+m4+m5+ . . . +mn
m2+m4
m2+m4+m5
m2+m4+m5+ . . . +mn
m2+m5
m2+m5+ . . . +mn
. . . , etc. . . .

5. Multi-Overlapped Primer Extensions

Another method that can be employed to generate combinations of two or more mutations is using oligonucleotide-mediated mutagenesis referred to as "multi overlapped primer extensions". This method can be used for the rational combination of mutant LEADs to form super-LEADS. This method allows the simultaneous introduction of several mutations throughout a small protein or protein-region of known sequence. Overlapping oligonucleotides of typically around 70 bases in length (since longer oligonucleotides lead to increased error) are designed from the DNA sequence (gene) encoding the mutant LEAD proteins in such a way that they overlap with each other on a region of typically around 20 bases. Although typically about 70 bases are used to create the overlapping oligonucleotides, the length of additional overlapping oligonucleotides for use can range from about 30 bases up to about 100 bases. Likewise, although typically the overlapping region of the overlapping oligonucleotides is about 20 bases, the length of other overlapping regions for use herein can range from about 5 bases up to about 40 bases. These overlapping oligonucleotides (including or not point mutations) act as template and primers in a first step of PCR (using a proofreading polymerase, such as, Pfu DNA polymerase, to avoid unexpected mutations) to create small amounts of full-length gene. The full-length gene resulting from the first PCR is then selectively amplified in a second step of PCR using flanking primers, each one tagged with a restriction site in order to facilitate subsequent cloning. One multi overlapped extension process yields a full-length (multi-mutated) nucleic acid molecule encoding a candidate super-LEAD protein having multiple mutations therein derived from LEAD mutant proteins.

E. MODIFIED FIX POLYPEPTIDES EXHIBITING INCREASED PROTEIN STABILITY, PARTICULARLY MODIFICATIONS THAT INCREASE RESISTANCE TO PROTEASES

Provided herein are modified FIX polypeptides (also referred to herein as variants of FIX) that display improved protein stability (i.e. increased protease resistance, or increased conformational stability that, for example, renders a polypeptide more resistant to denaturation by temperature or pH changes). A FIX polypeptide provided herein exhibiting increased protein stability can lead to an increased half-life of the polypeptide in vitro (such as, during production, purification and storage) or in vivo (such as, after administration to a subject). For example, increased half-life can occur following administration of the polypeptide to a subject, such as a human subject. The increased half-life of the modified FIX polypeptide can be increased by an amount that is at least about or 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the half-life of the unmodified FIX polypeptide. In some examples, the increased half-life of the modified FIX polypeptide can be increased by an amount that is at least 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more times when compared to the half-life of the unmodified FIX polypeptide. Hence, the modified FIX polypeptides provided herein offer FIX with advantages including a decrease in the frequency of injections needed to maintain a sufficient drug level in serum, thus leading to, for example, higher comfort and acceptance by subjects, lower doses necessary to achieve comparable biological effects and attenuation of secondary effects.

Provided herein are modified FIX polypeptides containing modifications that alter any one or more of the properties of FIX that contribute to increased protein stability, such as increased protease resistance, and any combinations of the modifications thereof. Increased protein stability can be accomplished by amino acid replacement, such that resistance to proteases by amino acid replacements can be achieved by direct destruction of the protease target residue or sequence. Generally, modified FIX polypeptides retain one or more activities of an unmodified FIX polypeptide. For example, the modified FIX polypeptides provided herein exhibit at least one activity that is substantially unchanged (less than 1%, 5% or 10% changed) compared to the unmodified or wild-type FIX. In other examples, the activity of a modified FIX polypeptide is increased or is decreased as compared to an unmodified FIX polypeptide. In another embodiment, the modified FIX polypeptides provided herein can inhibit an activity of the unmodified and/or wild-type native FIX polypeptide. Activity includes, for example, but not limited to blood coagulation, platelet binding, cofactor binding and protease activity. Activity can be assessed in vitro or in vivo and can be compared to the unmodified FIX polypeptide, such as for example, the mature, wild-type native FIX polypeptide (SEQ ID NO: 2), the wild-type precursor FIX polypeptide (SEQ ID NO: 1), or any other FIX polypeptide known to one of skill in the art that is used as the starting material.

Modified FIX polypeptides provided herein can be modified at one or more amino acid positions corresponding to amino acid positions of a mature FIX polypeptide, for example, a mature FIX polypeptide having an amino acid sequence set forth in SEQ ID NO: 2. FIX polypeptides can be modified compared to a mature or precursor FIX polypeptide having an amino acid sequence set forth in SEQ ID NO: 2 or 1, respectively. Modified FIX polypeptides provided herein include human FIX (hFIX) variants. An exemplary hFIX variant occurs at amino acid position 148 of the mature hFIX polypeptide, wherein the amino acid is Alanine or Threonine. The hFIX polypeptide can be of any human tissue or cell-type origin. Modified FIX polypeptides provided herein also include variants of FIX of non-human origin. Such alignments and selection of positions can be performed with any FIX polypeptide by aligning it with hFIX and selecting corresponding positions for modification. For example, modified FIX polypeptides can be variants of a non-human FIX, including, but not limited to, mouse, rat, guinea pig, cow, sheep, dog, cat, chicken, pig, rabbit, fish, and chimpanzee FIX. Exemplary unmodified non-human FIX polypeptides have amino acid sequences set forth in SEQ ID NOS: 898-912. Modified FIX polypeptides also include polypeptides that are hybrids of different FIX polypeptides and also synthetic FIX polypeptides prepared recombinantly or synthesized or constructed by other methods known in the art based upon known polypeptides.

Typically, modifications include replacement (substitution), addition, deletion or a combination thereof, of amino acid residues as described herein. Modified FIX polypeptides include those with 1, 2, 3, 4, 5, 6, 7, 8, 9, 10, 11, 12, 13, 14, 15, 16, 17, 18, 19, 20 or more modified positions. Generally, the modification results in increased stability without losing at least one activity, such as coagulant activity (i.e. retains at least one activity as defined herein) of an unmodified FIX polypeptide. A modified FIX exhibiting increased protein stability containing a single amino acid change at an is-HIT position as compared to an unmodified FIX is called a LEAD. FIX polypeptide candidate LEAD polypeptides can include amino acid replacement or replacements at any one or more of the is-HIT positions selected using methods described herein or known in the art, such as obtained using PAM analysis. Exemplary amino acid modifications corresponding to amino acid positions of a mature FIX polypeptide that can contribute to an increase in protein stability with respect to protease resistance are set forth in Table 5. In Table 5 below, the sequence identifier (SEQ ID NO.) is in parenthesis next to each substitution.

Also among the variants provided herein are modified FIX polypeptides with two or more modifications compared to native or wild-type FIX. Modified FIX polypeptides include those with 2, 3, 4, 5, 6, 7, 8, 9, 10, 11, 12, 13, 14, 15, 16, 17, 18, 19, 20 or more modified positions. The two or more modifications can include two or more modifications of the same property, such as, two modifications that modify resistance to proteases (blood, intestinal, etc.). In another embodiment, the two or more modifications include combinations of properties that each contribute to FIX stability. For example, a FIX variant can include one or more modifications that remove a protease sensitive site and one or more modifications that alter FIX conformational stability. FIX variants carrying replacements at more than one is-HIT sites and displaying improved stability are called super-LEADs. A FIX super-LEAD can for example, contain 2, 3, 4, 5, 6, 7, 8, 9, 10 or more than 10 amino acid changes compared to wild-type or unmodified FIX. In one example, a modified FIX polypeptide candidate super-LEAD can contain two or more amino acid modifications set forth in Table 5.

1. Protease Resistance

The delivery of stable peptide and protein drugs to patients is a major challenge for the pharmaceutical industry. These types of drugs in the human body are constantly eliminated or taken out of circulation by different physiological processes including internalization, glomerular filtration and proteolysis. The latter is often the limiting process affecting the half-life of proteins used as therapeutic agents in per-oral administration and either intravenous or intramuscular injections. To solve this problem, therapeutic proteins that increase protein stability manifested as an increased resistance to digestion by proteases are provided. Among modifications for therapeutic proteins are those that increase protection against protease digestion without destroying or completely eliminating a therapeutic use or the therapeutic activity. Such changes result in longer-lasting therapeutic proteins, and, also permit oral administration of therapeutic proteins.

FIX polypeptides provided herein are modified to increase resistance to proteolysis compared to in the absence of the modification. The resulting FIX polypeptides exhibit increased the half-life of the modified FIX polypeptide in vitro (such as, for production, processing, storage and assays.) and/or in vivo (such as, serum stability) and/or other properties, such as increased bioavailability upon oral administration. The modifications that alter susceptibility to cleavage by a proteases, unless specifically desired, do not alter activation cleavage sites for conversion of the zymogen into an activated form.

Proteases, proteinases or peptidases catalyze the hydrolysis of covalent peptidic bonds. Modified FIX polypeptides provided herein exhibit increased resistance to proteolysis by proteases, including those that occur, for example, in body fluids and tissues, such as those that include, but are not limited to, saliva, blood, serum, intestinal, stomach, blood, cell lysates, cells and others. These include proteases of all types, such as, for example, serine proteases and matrix metalloproteinases.

Modifications of FIX polypeptides result in resistance to one or more proteases that include, but are not limited to, pepsin, trypsin, chymotrypsin, elastase, aminopeptidase, gelatinase B, gelatinase A, α-chymotrypsin, carboxypeptidase, endoproteinase Arg-C, endoproteinase Asp-N, endoproteinase Glu-C, endoproteinase Lys-C, luminal pepsin, microvillar endopeptidase, dipeptidyl peptidase, enteropeptidase, hydrolase, NS3, factor Xa, Granzyme B, thrombin, plasmin, urokinase, tPA and PSA.

FIX polypeptides are cleaved by proteases and their activity reduced or inactivated. For example, human neutrophil elastase cleaves and inactivate FIX polypeptides after amino acid residues, such as T140, T144, I164, T172, and V181 (see, e.g., Takaki et al. (1983) *J. Clin. Invest.* 72: 1706-1715 and Samis et al. (1998) *Blood* 92(4): 1287-1296). In another example, thrombin cleaves and inactivates FIX polypeptides after amino acid residues, such as R318 and R327 (see, e.g., Kisiel et al. Blood 66(6): 1302-1308 (1985). Plasmin cleaves and inactivates FIX polypeptides after amino acid residues (Samis et al. (2000) *Blood* 95(3) 943-951). As shown herein, modifications of FIX polypeptides at sites, such as such as K43, R145, R180, K316, and R318 increase resistance of the FIX polypeptides to hydrolysis a protease. In a non-limiting example, modification of T140, T144, I164, T172 and/or V181 or other sites of a mature FIX polypeptide is shown herein to increase resistance to elastase.

Modified FIX polypeptides provided herein exhibit increased resistance to proteolysis, particularly by enzymes present in serum, blood, the gut, the mouth and other body fluids. Such increase in resistance can manifested as increased half-life of the FIX polypeptide by an amount that is at least about or 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the unmodified or wild-type FIX polypeptide in either in vivo (such as in human blood, human serum, saliva, digestive fluid and the intestinal tract) and/or an in vitro mixture containing one or more proteases. Increased resistance also is manifested by increased bioavailability upon oral administration. As described herein, therapeutic proteins are not generally amenable to oral administration by virtue of the activity of digestive and/or blood and serum proteases. The modified FIX polypeptides provided herein can be administered orally. Hence, as described herein, provided are oral compositions containing a modified FIX polypeptide. The oral compositions do not require additional protease inhibitors nor any additional modifications of the FIX polypeptides. Additional modifications of the FIX polypeptides are optional.

Typically, the half-life in vitro or in vivo of the modified FIX polypeptides provided herein is increased by an amount selected from at least about or 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more when compared to the half-life of unmodified or wild-type FIX in either blood, serum, or in an in vitro preparation or an in vitro mixture containing one or more proteases.

Typically, the modified FIX polypeptides provided herein exhibit at least one activity that is substantially unchanged (less than 1%, 5% or 10% changed) compared to the unmodified or wild-type FIX. In some examples, the activity is increased compared to the unmodified FIX. In other examples, the activity is decreased compared to the unmodified FIX polypeptide. The activity is retained at level so that the FIX polypeptide can be used therapeutically for the desired purpose. Activity includes, for example, blood coagulation activity, and can be compared to the unmodified polypeptide, such as for example, the mature, wild-type native FIX polypeptide (SEQ ID NO: 2), the wild-type precursor FIX polypeptide (SEQ ID NO: 1), or any other FIX polypeptide used as the starting material. In another embodiment the modified FIX polypeptide can inhibit one or more activities of an unmodified FIX polypeptide and/or act as an anticoagulant.

The FIX polypeptides can be modified to have resistance to a variety of proteases. These include, for example, members of the serine protease family and also metalloproteinases.

a. Serine Proteases

Serine proteases participate in a range of functions in the body, including blood clotting, inflammation as well as digestive enzymes in prokaryotes and eukaryotes. Serine proteases are sequence specific. While cascades of protease activations control blood clotting and complement, other proteases are involved in signaling pathways, enzyme activation and degradative functions in different cellular or extracellular compartments.

Serine proteases include, but are not limited, to chymotrypsin, trypsin, elastase, NS3, factor Xa, Granzyme B, thrombin, plasmin, urokinase, tPA and PSA. Chymotrypsin, trypsin and elastase are synthesized by the pancreatic acinar cells, secreted in the small intestine and are responsible for catalyzing the hydrolysis of peptide bonds. All three of these enzymes are similar in structure, as shown through their X-ray structures. Each of these digestive serine proteases targets different regions of the polypeptide chain, based upon the amino acid residues and side chains surrounding the site of cleavage. The active site of serine proteases is shaped as a cleft where the polypeptide substrate binds. Amino acid residues are labeled from N to C term of the polypeptide substrate (Pi, ..., P3, P2, P1, P1', P2', P3', ..., Pj) and their respective binding sub-sites (Si, ..., S3, S2, S1, S1', S2', S3', ..., Sj). The cleavage is catalyzed between P1 and P1'. Chymotrypsin hydrolyzes peptide bonds flanked with bulky hydrophobic amino acid residues. Particular residues include phenylalanine, tryptophan and tyrosine, which fit into a snug hydrophobic pocket. Trypsin hydrolyzes peptide bonds flanked with positively charged amino acid residues. Instead of having the hydrophobic pocket of the chymotrypsin, trypsin possesses an aspartic acid residue at the back of the pocket, which can interact with positively charged residues such as arginine and lysine. Elastase hydrolyzes peptide bonds flanked with small neutral amino acid residues, such as alanine, glycine and valine. In contrast to trypsin and chymotrypsin, elastase contains a pocket that is lined with valine and threonine, rendering it a mere depression, which can accommodate the smaller amino acid residues. Serine proteases are ubiquitous in prokaryotes and eukaryotes and serve important and diverse biological functions such as hemostasis, fibrinolysis, complement formation and the digestion of dietary proteins. Coagulation factors, such as FIX, FVII and FX possess serine protease domains that hydrolyze specific members of the coagulation cascade.

Elastases that belong to the serine protease family display extensive sequence homology to other known serine proteases, including trypsin and chymotrypsin. Serine elastases preferentially cleave polypeptides adjacent to aliphatic amino acids residues, typically alanine, valine and methionine, and to a lesser extent, leucine and isoleucine. Humans have six elastase genes which encode the structurally similar proteins, elastase 1 (ELA-1, also known as pancreatic elastase, PE), elastase 2 (neutrophil elastase, NE, also known as PMN elastase, bone marrow serine protease, medullasin, human leukocyte elastase, HLE), elastase 2A (ELA-2A), elastase 2B (ELA-2B), elastase 3A (ELA-3A, elastase IIIA, Protease E), and elastase-3B (ELA-3B, elastase IIIB, protease E). Other serine proteases with elastase activity include, but are not limited to, proteinase-3 (PR-3), endogenous vascular elastase (EVE), and endothelial cell elastase (ECE).

Neutrophil primary azurophil granules carry NE (ELA-2) and PR-3, which are released upon neutrophil activation. NE is involved in degradation of the extracellular matrix and (ECM), including degradation of elastin, cartilage proteoglycans, collagens, and fibronectin, and digestion of material taken into the cell by phagocytosis. NE also helps in degradation of proteins, such as immunoglobulins and surfactant apoproteins. NE preferentially cleaves Val-X bonds and to a lesser extent Ala-X bonds. Abnormal or excessive release of NE has been linked to defects in connective tissue turnover, arthritis and inflammation. Like NE, PR-3 also functions to activate proenzymes, such as metalloproteinases, and cytokines, such as TNF-α, IL-1β, and interleukin-8 (IL-8).

Pancreatic elastase (ELA-1) preferentially cleaves Ala-X bonds and is expressed primarily in skin keratinocytes. Expression of ELA is not normally found in the adult pancreas though it is often expressed in and used as a marker for pancreatic cancers. Elastase activity of the normal pancreas is attributable to ELA-2A and ELA-2B. ELA-2A and ELA-2B preferentially cleaves Leu-X, Met-X and Phe-X bonds.

Some pathological conditions are result at least in part from an imbalance between the elastases and their endogenous inhibitors. Uncontrolled proteolytic degradation by neutrophil elastases, especially ELA-2 has been implicated in a number of pathological conditions like pulmonary emphysema, acute respiratory distress syndrome, septic shock, multiple organ failure, rheumatoid arthritis and cystic fibrosis.

High concentrations of elastases can be found in the gastrointestinal tract and blood stream. Hence, effective therapeutics to be administered via these routes can be achieved through modification of elastase cleavage sites. As mentioned above, FIX is known to be cleaved by human neutrophil elastase (HNE) at amino acid positions T140, T144, I164, T172 and V181 of a mature FIX polypeptide. Cleavage of FIX by HNE generates a FIX polypeptide without coagulant activity. Modification of FIX polypeptides at one or more elastase cleavage sites can increase resistance of FIX polypeptides to proteolytic degradation and thus, improve the therapeutic properties of the FIX polypeptide.

Increased levels of elastase are associated with coagulation disease states, such as disseminated intravascular coagulation (DIC), wherein there is a depletion of active coagulation factors. The decrease in pool of coagulation factors can result in excessive bleeding at sites of tissue damage due to the deficiency in clotting factors needed at the injury location. Modification of FIX polypeptides at elastase cleavage sites, such as the modified FIX polypeptides provided herein, can increase the resistance of FIX polypeptides to elevated levels of elastase in such disease states and thus, improve the therapeutic effectiveness of FIX polypeptides.

b. Matrix Metalloproteinases

Matrix metalloproteinases (MMPs) are a family of $Zn^{2+}$- and calcium-dependent endopeptidases that degrade components of the extracellular matrix (ECM). In addition, MMPs also can process a number of cell-surface cytokines, receptors and other soluble proteins. They are involved in normal tissue remodeling processes such as wound healing, pregnancy and angiogenesis. Under physiological conditions, MMPs are made as inactive precursors (zymogens) and are processed to their active form. Additionally, the enzymes are specifically regulated by endogenous inhibitors called tissue inhibitors of matrix metalloproteinases (TIMPs). The proteolytic activity of MMPs acts as an effector mechanism of tissue remodeling in physiologic and pathologic conditions, and as modulator of inflammation. The excess synthesis and production of these proteins lead to accelerated degradation of the ECM which is associated with a variety of diseases and conditions such as, for example, bone homeostasis, arthritis, cancer, multiple sclerosis and rheumatoid arthritis. In the context of neuroinflammatory diseases, MMPs have been implicated in processes such as (a) blood-brain barrier (BBB) and blood-nerve barrier opening, (b) invasion of neural tissue by blood-derived immune cells, (c) shedding of cytokines and cytokine receptors, and (d) direct cellular damage in diseases of the peripheral and central nervous system (Leppert et al. (2001) Brain Res. Rev. 36(2-3): 249-57; Borkakoti et al. (1998) Prog. Biophys. Mol. Biol. 70(1): 73-94).

Members of the MMP family include collagenases, gelatinases, stromelysins, matrilysin and membrane-bound MMPs. Most MMPs are secreted in the inactive proenzyme form. The secreted proenzyme MMPs can be activated by several proinflammatory agents such as oxidants, proteinases including elastase, plasmin, and trypsin, and other MMPs (Cuzner and Opdenakker (1999) J. Neuroimmunol. 94(1-2): 1-14). In tissues, physiological MMP activators include tissue or plasma proteinases or opportunistic bacterial proteinases. For example, the plasminogen activator/plasmin system, including ubiquitous plasminogen by urokinase (u-Pa) and tissue-type plasminogen activator (t-Pa), is an important activator of pro-MMP in pathological situations. MMP activity can be inhibited by tissue inhibitors of metalloproteinases (TIMPs), by serine proteinase inhibitors (serpins), and by nonspecific proteinase inhibitors, such as α2-macroglobulin. TIMPs inhibit the MMP activity through noncovalent binding of the active zinc-binding sites of MMPs. Proteolytic activities of MMPs and plasminogen activators, and their inhibitors, are important in maintaining the integrity of the ECM as cell-ECM interactions influence and mediate a wide range of processes including proliferation, differentiation, adhesion and migration of a variety of cell types. Excessive production of matrix metalloproteinases has been implicated in tissue damage and wound healing, inflammatory disorders, proliferative disorders and autoimmune diseases (St-Pierre et al. (2003) Curr. Drug Targets Inflamm. Allergy 2(3): 206-215; Opdenakker (1997) G. Verh. K Acad. Geneeskd. Belg. 59(6): 489-514).

c. Increased Resistance to Proteolysis by Removal of Proteolytic Sites

As exemplified herein, the 2D-scanning methodology was used to identify the amino acids of hFIX that lead to an increase in stability when challenged with proteases (such as blood and/or intestinal proteins), blood lysate and/or serum. Increasing protein stability to proteases (such as blood, lysate and intestinal serum), provides a longer in vivo half-life for the particular protein molecules. This can reduce the frequency of administered doses and/or the total amount administered.

A first step in the design of hFIX mutants provided resistant to proteolysis included identifying sites vulnerable to proteolysis along the protein sequence. Based on a list of selected blood, intestinal or any other type of proteases considered (Table 4), the complete list of all amino acids and sequences of amino acids in hFIX that can be targeted by those proteases was first determined in silico. The protease targets (amino acids or sequences of amino acids along the hFIX polypeptide) are named in silico HITs (is-HITs).

The second step in the design of hFIX mutants that are resistant to proteolysis included identifying the appropriate replacing amino acids such that if they replaced the natural amino acids in hFIX at is-HITs, the protein (i) becomes resistant to proteolysis; and (ii) elicits a level of activity at least comparable to the wild-type hFIX polypeptide. In another embodiment the protein (i) becomes resistant to proteolysis; and (ii) inhibits an activity of the wild-type hFIX polypeptide and/or acts as an anticoagulant. The choice of the replacing amino acids included consideration of the broad target specificity of certain proteases and the need to preserve the physicochemical properties such as hydrophobicity, charge and polarity of essential (such as, catalytic, binding, etc.) residues in hFIX.

"Point Accepted Mutation" (PAM; Dayhoff et al., 1978) can be used as part of the 2D scanning approach. PAM values, originally developed to produce alignments between protein sequences, are available in the form of probability matrices that reflect an evolutionary distance between amino acids. Conservative substitutions of a residue in a reference sequence are those substitutions that are physically and functionally similar to the corresponding reference residues, i.e., that have a similar size, shape, electric charge, and/or chemical properties, including the ability to form covalent or hydrogen bonds and other such interactions. Conservative substitutions show the highest scores fitting with the PAM matrix criteria in the form of accepted point mutations. The PAM250 matrix is used in the frame of 2D-scanning to identify candidate replacing amino acids for the is-HITs in order to generate conservative mutations without affecting protein function. At least two amino acids with the highest values in PAM250 matrix corresponding to conservative substitutions or accepted point mutations were chosen for replacement at each is-HIT. The replacement of amino acids by cysteine residues is explicitly avoided since this change can lead to the formation of intermolecular disulfide bonds.

Briefly, using the algorithm PROTEOL (on-line at infobiogen.fr and at bioinfo.hku.hk/services/analyseq/cgi-bin/proteol_in.pl), a list of residues along the mature hFIX polypeptide of 415 amino acids (SEQ ID NO: 2), which can be recognized as substrate for proteases (blood, intestinal, etc.) in Table 4 was established. The algorithm generates a proteolytic digestion map based on a list of proteases, the proteolytic specificity of the proteases, and the polypeptide amino acid sequence that is entered. Table 4 shows the in silico identification of amino acid positions that are targets for proteolysis using selected proteases and chemical treatment.

TABLE 4

| Abbreviation | Amino Acid Position | Protease or Chemical Treatment |
| --- | --- | --- |
| AspN | D | Endoproteinase Asp-N |
| Chymo | (F,W,Y,M,L)~P | Chymotrypsin |
| Clos | R | Clostripain |
| CnBr | M | Cyanogen Bromide |
| IBzO | W | IodosoBenzoate |
| Myxo | K | Myxobacter |
| NH$_2$OH | N G | Hydroxylamine |
| pH2.5 | D P | pH 2.5 |
| ProEn | P | Proline Endopeptidase |
| Staph | E | Staphylococcal Protease |
| Tryp | (K,R)~P | Trypsin |
| TrypK | K~P | Trypsin (Arg blocked) |
| TrypR | R~P | Trypsin (Lys blocked) |

Is-HITS were identified and LEADS created for higher resistance to proteolysis of hFIX. The native amino acids at each of the is-HIT positions and replacing amino acids for increased resistance to proteolysis can include, but are not limited to replacing any of Y, A, L, S, T, I, V, F, Q and M by any of E, D, K, R, N, Q, S and T. Is-HITS and LEADs can include modifications at regions susceptible to proteolysis.

d. Modified FIX Polypeptides Exhibiting Increased Protease Resistance

Using such methods as outlined above, modified FIX proteins were generated. Sites, designated is-HIT positions, were identified and modified proteins prepared. The resulting proteins exhibited increased protease resistance. This was manifested as, for example, increased the methods described herein, the following is-HIT positions were identified to eliminate protease sensitive sites and increase protein stability of a FIX polypeptide. In addition, the modified FIX proteins can be administered orally and deliver therapeutically effective dosages to the blood.

Among the modified FIX polypeptides provided herein are those that included modifications at one or more loci. Typically modified FIX polypeptides include one, two, three, four or five such modifications. In addition, the background polypeptide that is modified can include other modifications known to alter desired properties, such as modification of sites to decrease immunogenicity and/or to increase glycosylation. The polypeptides can include further modifications, such as pegylation.

Provided herein are modified FIX polypeptides that include modifications of the amino acids at positions selected from among one or more of the following: 1, 3, 4, 5, 6, 7, 8, 9, 10, 14, 15, 16, 17, 19, 20, 21, 22, 24, 25, 26, 27, 28, 29, 30, 31, 32, 33, 35, 36, 37, 38, 39, 40, 41, 42, 43, 45, 46, 47, 48, 49, 52, 53, 55, 57, 58, 59, 60, 61, 63, 64, 65, 66, 68, 69, 70, 72, 74, 75, 76, 77, 78, 79, 80, 82, 83, 84, 85, 86, 87, 90, 91, 92, 93, 94, 96, 98, 100, 101, 102, 103, 104, 106, 107, 108, 110, 112, 113, 114, 115, 116, 117, 118, 119, 122, 123, 125, 126, 127, 128, 129, 131, 133, 134, 135, 136, 137, 138, 140, 141, 142, 143, 144, 145, 146, 147, 148, 149, 151, 152, 153, 154, 155, 156, 158, 159, 160, 161, 162, 163, 164, 165, 166, 168, 169, 171, 172, 174, 175, 177, 178, 179, 180, 181, 182, 183, 184, 185, 186, 187, 188, 189, 190, 192, 193, 194, 196, 197, 198, 199, 200, 201, 202, 203, 204, 205, 207, 208, 209, 210, 211, 213, 214, 215, 216, 217, 218, 219, 220, 223, 224, 225, 226, 227, 228, 229, 230, 231, 232, 233, 234, 235, 238, 239, 240, 241, 242, 244, 245, 247, 248, 250, 251, 252, 253, 254, 255, 259, 261, 262, 263, 265, 266, 269, 270, 271, 272, 273, 274, 275, 276, 277, 278, 279, 280, 281, 283, 284, 285, 286, 287, 288, 290, 291, 292, 293, 294, 295, 296, 298, 299, 300, 301, 302, 303, 304, 305, 306, 307, 308, 309, 310, 311, 312, 313, 314, 316, 317, 318, 319, 320, 321, 322, 323, 325, 326, 327, 328, 329, 330, 331, 332, 333, 334, 335, 337, 338, 339, 340, 341, 342, 343, 344, 345, 348, 349, 351, 352, 353, 355, 356, 357, 358, 359, 360, 363, 364, 365, 366, 367, 368, 370, 371, 372, 373, 374, 375, 376, 377, 378, 379, 380, 381, 382, 383, 384, 385, 386, 387, 388, 390, 391, 392, 393, 394, 395, 396, 397, 398, 399, 400, 401, 402, 403, 404, 405, 407, 408, 409, 410, 411, 412, 413, 414, and 415. These positions (loci) are relative to the mature FIX polypeptide whose sequence is set forth in SEQ ID NO.: 2 or 1035 or corresponding loci in an allelic or species variant and/or in a background polypeptide (starting FIX polypeptide) including other modifications. The FIX polypeptides include precursor forms and mature forms, zymogens and activated forms.

In particular examples, amino acid replacement or replacements can be at any one or more positions corresponding to any of the following positions: Y1, S3, G4, K5, L6, E7, E8, F9, V10, G12, L14, E15, R16, E17, M19, E20, E21, K22, S24, F25, E26, E27, A28, R29, E30, V31, F32, E33, T35, E36, R37, T38, T39, E40, F41, W42, K43, Y45, V46, D47, G48, D49, E52, S53, P55, L57, N58, G59, G60, S61, K63, D64, D65, I66, S68, Y69, E70, W72, P74, F75, G76, F77, E78, G79, K80, E83, L84, D85, V86, T87, I90, K91, N92, G93, R94; E96, F98, K100, S102, A103, D104, K106, V107, V108, S110, T112, E113, G114, Y115, R116, L117, A118, E119, K122, S123, E125, P126, A127, V128, P129, P131, G133, R134, V135, S136, V137, S138, T140, S141, K142, L143, T144, R145, A146, E147, T148, V149, P151, D152, V153, D154, Y155, V156, S158, T159, E160, A161, E162, T163, I164, L165, D166, I168, T169, S171, T172, S174, F175, D177, F178, T179, R180, V181, V182, G183, G184, E185, D186, A187, K188, P189, G190, F192, P193, W194, V196, V197, L198, N199, G200, K201, V202, D203, A204, F205, G207, G208, S209, I210, V211, E213, K214, W215, I216, V217, T218, A219, A220, V223, E224, T225, G226, V227, K228, I229, T230, V231, V232, A233, G234, E235, I238, E239, E240, T241, E242, T244, E245, K247, R248, V250, I251, R252, I253, I254, P255, Y259, A261, A262, I263, K265, Y266, D269, I270, A271, L272, L273, E274, L275, D276, E277, P278, L279, V280, L281, S283, Y284, V285, T286, P287, I288, I290, A291, D292, K293, E294, Y295, T296, I298, F299, L300, K301, F302, G303, S304, G305, Y306, V307, S308, G309, W310, G311, R312, V313, F314, K316, G317, R318, S319, A320, L321, V322, L323, Y325, L326, R327, V328, P329, L330, V331, D332, R333, A334, T335, L337, R338, S339, T340, K341, F342, T343, I344, Y345, M348, F349, A351, G352, F353, E355, G356, G357, R358, D359, S360, G363, D364, S365, G366, G367, P368, V370, T371, E372, V373, E374, G375, T376, S377, F378, L379, T380, G381, I382, I383, S384, W385, G386, E387, E388, A390, M391, K392, G393, K394, Y395, G396, I397, Y398, T399, K400, V401, S402, R403, Y404, V405, W407, I408, K409, E410, K411, T412, K413, L414, and T415 of a mature FIX polypeptide set forth in SEQ ID NO: 2 or in corresponding loci in an allelic or species variant and/or in a background polypeptide including other modifications.

In one embodiment, positions are typically replaced as follows: replacement of D with N or Q, replacement of E with H, Q or N, replacement of F with I or V, replacement of K with Q or N, replacement of L with I or V, replacement of M with I or V, replacement of N with Q or S, replacement of P with A or S, replacement of R with H or Q, replacement of W with H or S, replacement of Y with I or H, replacement of A, G, I, S, T, or V with Q, H, or N.

In one embodiment, positions corresponding to hFIX are selected (is-HITS) and amino acid replacements are made (LEADs) with increased resistance to proteolysis that include, but are not limited to replacements corresponding to those set forth in Table 5, where the replacements are made compared to the sequence of amino acids set forth in SEQ ID NO: 2. Table 5 provides non-limiting examples of amino acid replacements, corresponding to amino acid positions of a mature FIX polypeptide, that increase resistance to proteolysis and, thereby, protein stability. The modified FIX polypeptides include precursor and mature forms, zymogen and active forms, allelic and species variants and/or modifications in a background FIX polypeptide including other modifications.

In referencing such mutants, the first amino acid (one-letter abbreviation) corresponds to the amino acid that is replaced, the number corresponds to position in the hFIX polypeptide sequence with reference to SEQ ID NO: 2, and the second amino acid (one-letter abbreviation) corresponds to the amino acid selected that replaces the first amino acid at that position. In Table 5 below, the sequence identifier (SEQ ID NO.) is in parenthesis next to each substitution. The FIX polypeptides employed for modification can be any FIX polypeptide, including other mammalian FIX polypeptides. Corresponding positions, as assessed by appropriate alignment, are identified and modified as described herein.

TABLE 5

List of Human FIX Modifications to Increase Resistance to Proteolysis

| | | | | | | |
|---|---|---|---|---|---|---|
| Y1H (3) | Y1I (4) | K5N (5) | K5Q (6) | L6I (7) | L6V (8) | E7Q (9) |
| E7H (10) | E7N (11) | E8Q (12) | E8H (13) | E8N (14) | F9I (15) | F9V (16) |
| L14I (17) | L14V (18) | E15Q (19) | E15H (20) | E15N (21) | R16H (22) | R16Q (23) |
| E17Q (24) | E17H (25) | E17N (26) | M19I (27) | M19V (28) | E20Q (29) | E20H (30) |
| E20N (31) | E21Q (32) | E21H (33) | E21N (34) | K22N (35) | K22Q (36) | F25I (37) |
| F25V (38) | E26Q (39) | E26H (40) | E26N (41) | E27Q (42) | E27H (43) | E27N (44) |
| R29H (45) | R29Q (46) | E30Q (47) | E30H (48) | E30N (49) | F32I (50) | F32V (51) |
| E33Q (52) | E33H (53) | E33N (54) | E36Q (55) | E36H (56) | E36N (57) | R37H (58) |
| R37Q (59) | E40Q (60) | E40H (61) | E40N (62) | F41I (63) | F41V (64) | W42S (65) |
| W42H (66) | K43N (67) | K43Q (68) | Y45H (69) | Y45I (70) | D47N (71) | D47Q (72) |
| D49N (73) | D49Q (74) | E52Q (75) | E52H (76) | E52N (77) | P55A (78) | P55S (79) |
| L57I (80) | L57V (81) | N58Q (82) | N58S (83) | K63N (84) | K63Q (85) | D64N (86) |
| D64Q (87) | D65N (88) | D65Q (89) | Y69H (90) | Y69I (91) | E70Q (92) | E70H (93) |
| E70N (94) | W72S (95) | W72H (96) | P74Q (97) | P74S (98) | F75I (99) | F75V (100) |
| F77I (101) | F77V (102) | E78Q (103) | E78H (104) | E78N (105) | K80N (106) | K80Q (107) |
| E83Q (108) | E83H (109) | L84I (111) | L84V (112) | D85N (113) | D85Q (114) | |
| K91N (115) | K91Q (116) | N92Q (117) | N92S (118) | R94H (119) | R94Q (120) | E96Q (121) |
| E96H (122) | E96N (123) | F98I (124) | F98V (125) | K100N (126) | K100Q (127) | D104N (128) |
| D104Q (129) | K106N (130) | K106Q (131) | E113Q (132) | E113H (133) | E113N (134) | Y115H (135) |
| Y115I (136) | R116H (137) | R116Q (138) | L117I (139) | L117V (140) | E119Q (141) | E119H (142) |
| E119N (143) | K122N (144) | K122Q (145) | E125Q (146) | E125H (147) | E125N (148) | P126A (149) |
| P126S (150) | P129A (151) | P129S (152) | P131A (153) | P131S (154) | R134H (155) | R134Q (156) |
| K142N (157) | K142Q (158) | L143I (159) | L143V (160) | R145H (161) | R145Q (162) | E147Q (163) |
| E147H (164) | E147N (165) | P151A (166) | P151S (167) | D152N (168) | D152Q (169) | D154N (170) |
| D154Q (171) | Y155H (172) | Y155I (173) | E160Q (174) | E160H (175) | E160N (176) | E162Q (177) |
| E162H (178) | E162N (179) | L165I (180) | L165V (181) | D166N (182) | D166Q (183) | F175I (184) |
| F175V (185) | D177N (186) | D177Q (187) | F178I (188) | F178V (189) | R180H (190) | R180Q (191) |
| E185Q (192) | E185H (193) | E185N (194) | D186N (195) | D186Q (196) | K188N (197) | K188Q (198) |
| P189A (199) | P189S (200) | P193A (201) | P193S (202) | W194S (203) | W194H (204) | L198I (205) |
| L198V (206) | N199Q (207) | N199S (208) | K201N (209) | K201Q (210) | D203N (211) | D203Q (212) |
| F205I (213) | F205V (214) | E213Q (215) | E213H (216) | E213N (217) | K214N (218) | K214Q (219) |
| W215S (220) | W215H (221) | E224Q (222) | E224H (223) | E224N (224) | K228N (225) | K228Q (226) |
| E235Q (227) | E235H (228) | E235N (229) | E239Q (230) | E239H (231) | E239N (232) | E240Q (233) |
| E240H (234) | E240N (235) | E242Q (236) | E242H (237) | E242N (238) | E245Q (239) | E245H (240) |
| E245N (241) | K247N (242) | K247Q (243) | R248H (244) | R248Q (245) | R252H (246) | R252Q (247) |
| P255A (248) | P255S (249) | Y259H (250) | Y259I (251) | K265N (252) | K265Q (253) | Y266H (254) |
| Y266I (255) | D269N (256) | D269Q (257) | L272I (258) | L272V (259) | L273I (260) | L273V (261) |
| E274Q (262) | E274H (263) | E274N (264) | L275I (265) | L275V (266) | D276N (267) | D276Q (268) |
| E277Q (269) | E277H (270) | E277N (271) | P278A (272) | P278S (273) | L279I (274) | L279V (275) |
| L281I (276) | L281V (277) | Y284H (278) | Y284I (279) | P287A (280) | P287S (281) | D292N (282) |
| D292Q (283) | K293N (284) | K293Q (285) | E294Q (286) | E294H (287) | E294N (288) | Y295H (289) |
| Y295I (290) | F299I (291) | F299V (292) | L300I (293) | L300V (294) | K301N (295) | K301Q (296) |
| F302I (297) | F302V (298) | Y306H (299) | Y306I (300) | W310S (301) | W310H (302) | R312H (303) |
| R312Q (304) | F314I (305) | F314V (306) | K316N (307) | K316Q (308) | R318H (309) | R318Q (310) |
| L321I (311) | L321V (312) | L323I (313) | L323V (314) | Y325I (315) | Y325I (316) | L326I (317) |
| L326V (318) | R327H (319) | R327Q (320) | P329A (321) | P329S (322) | L330I (323) | L330V (324) |
| D332N (325) | D332Q (326) | R333H (327) | R333Q (328) | L337I (329) | L337V (330) | R338H (331) |
| R338Q (332) | K341N (333) | K341Q (334) | F342I (335) | F342V (336) | Y345H (337) | Y345I (338) |
| M348I (339) | M348V (340) | F349I (341) | F349V (342) | F353I (343) | F353V (344) | E355Q (345) |
| E355H (346) | E355N (347) | R358H (348) | R358Q (349) | D359N (350) | D359Q (351) | D364N (352) |
| D364Q (353) | P368A (354) | P368S (355) | E372Q (356) | E372H (357) | E372N (358) | E374Q (359) |
| E374H (360) | E374N (361) | F378I (362) | F378V (363) | L379I (364) | L379V (365) | W385S (366) |
| W385H (367) | E387Q (368) | E387H (369) | E387N (370) | E388Q (371) | E388H (372) | E388N (373) |
| M391I (374) | M391V (375) | K392N (376) | K392Q (377) | K394N (378) | K394Q (379) | Y395H (380) |
| Y395I (381) | Y398H (382) | Y398I (383) | K400N (384) | K400Q (385) | R403H (386) | R403Q (387) |
| Y404H (388) | Y404I (389) | W407S (390) | W407H (391) | K409N (392) | K409Q (393) | E410Q (394) |
| E410H (395) | E410N (396) | K411N (397) | K411Q (398) | K413N (399) | K413Q (400) | L414I (401) |
| L414V (402) | S3N (403) | S3Q (404) | G4N (406) | G4Q (407) | G4H (408) | |
| V10N (409) | V10Q (410) | V10H (411) | G12N (412) | G12Q (413) | G12H (414) | S24N (415) |
| S24Q (416) | S24H (417) | A28N (418) | A28Q (419) | A28H (420) | V31N (421) | V31Q (422) |
| V31H (423) | T35N (424) | T35Q (425) | T35H (426) | T38N (427) | T38Q (428) | T38H (429) |
| T39N (430) | T39Q (431) | T39H (432) | V46N (433) | V46Q (434) | V46H (435) | G48N (436) |
| G48Q (437) | G48H (438) | S53N (439) | S53Q (440) | S53H (441) | G59N (442) | G59Q (443) |
| G59H (444) | G60N (445) | G60Q (446) | G60H (447) | S61N (448) | S61Q (449) | S61H (450) |
| I66N (451) | I66Q (452) | I66H (453) | S68N (454) | S68Q (455) | S68H (456) | G76N (457) |
| G76Q (458) | G76H (459) | G79N (460) | G79Q (461) | G79H (462) | V86N (463) | V86Q (464) |
| V86H (465) | T87N (466) | T87Q (467) | T87H (468) | I90N (469) | I90Q (470) | I90H (471) |
| G93N (472) | G93Q (473) | G93H (474) | S102N (475) | S102Q (476) | S102H (477) | A103N (478) |
| A103Q (479) | A103H (480) | V107N (481) | V107Q (482) | V107H (483) | V108N (484) | V108Q (485) |
| V108H (486) | S110N (487) | S110Q (488) | S110H (489) | T112N (490) | T112Q (491) | T112H (492) |
| G114N (493) | G114Q (494) | G114H (495) | A118N (496) | A118Q (497) | A118H (498) | S123N (499) |
| S123Q (500) | S123H (501) | A127N (502) | A127Q (503) | A127H (504) | V128N (505) | V128Q (506) |
| V128H (507) | G133N (508) | G133Q (509) | G133H (510) | V135N (511) | V135Q (512) | V135H (513) |

TABLE 5-continued

List of Human FIX Modifications to Increase Resistance to Proteolysis

| | | | | | | |
|---|---|---|---|---|---|---|
| S136N (514) | S136Q (515) | S136H (516) | V137N (517) | V137Q (518) | V137H (519) | S138N (520) |
| S138Q (521) | S138H (522) | T140N (523) | T140Q (524) | T140H (525) | S141N (526) | S141Q (527) |
| S141H (528) | T144N (529) | T144Q (530) | T144H (531) | A146N (532) | A146Q (533) | A146H (534) |
| T148N (535) | T148Q (536) | T148H (537) | V149N (538) | V149Q (539) | V149H (540) | V153N (541) |
| V153Q (542) | V153H (543) | V156N (544) | V156Q (545) | V156H (546) | S158N (547) | S158Q (548) |
| S158H (549) | T159N (550) | T159Q (551) | T159H (552) | A161N (553) | A161Q (554) | A161H (555) |
| T163N (556) | T163Q (557) | T163H (558) | I164N (559) | I164Q (560) | I164H (561) | I168N (562) |
| I168Q (563) | I168H (564) | T169N (565) | T169Q (566) | T169H (567) | S171N (568) | S171Q (569) |
| S171H (570) | T172N (571) | T172Q (572) | T172H (573) | S174N (574) | S174Q (575) | S174H (576) |
| T179N (577) | T179Q (578) | T179H (579) | V181N (580) | V181Q (581) | V181H (582) | V182N (583) |
| V182Q (584) | V182H (585) | G183N (586) | G183Q (587) | G183H (588) | G184N (589) | G184Q (590) |
| G184H (591) | A187N (592) | A187Q (593) | A187H (594) | G190N (595) | G190Q (596) | G190H (597) |
| V196N (598) | V196Q (599) | V196H (600) | V197N (601) | V197Q (602) | V197H (603) | G200N (604) |
| G200Q (605) | G200H (606) | V202N (607) | V202Q (608) | V202H (609) | A204N (610) | A204Q (611) |
| A204H (612) | G207N (613) | G207Q (614) | G207H (615) | G208Q (616) | G208Q (617) | G208H (618) |
| S209N (619) | S209Q (620) | S209H (621) | I210N (622) | I210Q (623) | I210H (624) | V211N (625) |
| V211Q (626) | V211H (627) | I216N (628) | I216Q (629) | I216H (630) | V217N (631) | V217Q (632) |
| V217H (633) | T218N (634) | T218Q (635) | T218H (636) | A219N (637) | A219Q (638) | A219H (639) |
| A220N (640) | A220Q (641) | A220H (642) | V22N (643) | V223Q (644) | V223H (645) | T225N (646) |
| T225Q (647) | T225H (648) | G226N (649) | G226Q (650) | G226H (651) | V227N (652) | V227Q (653) |
| V227H (654) | I229N (655) | I229Q (656) | I229H (657) | T230N (658) | T230Q (659) | T230H (660) |
| V231N (661) | V231Q (662) | V231H (663) | V232N (664) | V232Q (665) | V232H (666) | A233N (667) |
| A233Q (668) | A233H (669) | G234N (670) | G234Q (671) | G234H (672) | I238N (673) | I238Q (674) |
| I238H (675) | T241N (676) | T241Q (677) | T241H (678) | T244N (679) | T244Q (680) | T244H (681) |
| V250N (682) | V250Q (683) | V250H (684) | I251N (685) | I251Q (686) | I251H (687) | I253N (688) |
| I253Q (689) | I253H (690) | I254N (691) | I254Q (692) | I254H (693) | A261N (694) | A261Q (695) |
| A261H (696) | A262N (697) | A262Q (698) | A262H (699) | I263N (700) | I263Q (701) | I263H (702) |
| I270N (703) | I270Q (704) | I270H (705) | A271N (706) | A271Q (707) | A271H (708) | V280N (709) |
| V280Q (710) | V280H (711) | S283N (712) | S283Q (713) | S283H (714) | V285N (715) | V285Q (716) |
| V285H (717) | T286N (718) | T286Q (719) | T286H (720) | I288N (721) | I288Q (722) | I288H (723) |
| I290N (724) | I290Q (725) | I290H (726) | A291N (727) | A291Q (728) | A291H (729) | T296N (730) |
| T296Q (731) | T296H (732) | I298N (733) | I298Q (734) | I298H (735) | G303N (736) | G303Q (737) |
| G303H (738) | S304N (739) | S304Q (740) | S304H (741) | G305N (742) | G305Q (743) | G305H (744) |
| V307N (745) | V307Q (746) | V307H (747) | S308N (748) | S308Q (749) | S308H (750) | G309N (751) |
| G309Q (752) | G309H (753) | G311N (754) | G311Q (755) | G311H (756) | V313N (757) | V313Q (758) |
| V313H (759) | G317N (760) | G317Q (761) | G317H (762) | S319N (763) | S319Q (764) | S319H (765) |
| A320N (766) | A320Q (767) | A320H (768) | V322N (769) | V322Q (770) | V322H (771) | V328N (772) |
| V328Q (773) | V328H (774) | V331N (775) | V331Q (776) | V331H (777) | A334N (778) | A334Q (779) |
| A334H (780) | T335N (781) | T335Q (782) | T335H (783) | S339N (784) | S339Q (785) | S339H (786) |
| T340N (787) | T340Q (788) | T340H (789) | T343N (790) | T343Q (791) | T343H (792) | I344N (793) |
| I344Q (794) | I344H (795) | A351N (796) | A351Q (797) | A351H (798) | G352N (799) | G352Q (800) |
| G352H (801) | G356N (802) | G356Q (803) | G356H (804) | G357N (805) | G357Q (806) | G357H (807) |
| S360N (808) | S360Q (809) | S360H (810) | G363N (811) | G363Q (812) | G363H (813) | S365N (814) |
| S365Q (815) | S365H (816) | G366N (817) | G366Q (818) | G366H (819) | G367N (820) | G367Q (821) |
| G367H (822) | V370N (823) | V370Q (824) | V370H (825) | T371N (826) | T371Q (827) | T371H (828) |
| V373N (829) | V373Q (830) | V373H (831) | G375N (832) | G375Q (833) | G375H (834) | T376N (835) |
| T376Q (836) | T376H (837) | S377N (838) | S377Q (839) | S377H (840) | T380N (841) | T380Q (842) |
| T380H (843) | G381N (844) | G381Q (845) | G381H (846) | I382N (847) | I382Q (848) | I382H (849) |
| I383N (850) | I383Q (851) | I383H (852) | S384N (853) | S384Q (854) | S384H (855) | G386N (856) |
| G386Q (857) | G386H (858) | A390N (859) | A390Q (860) | A390H (861) | G393N (862) | G393Q (863) |
| G393H (864) | G396N (865) | G396Q (866) | G396H (867) | I397N (868) | I397Q (869) | I397H (870) |
| T399N (871) | T399Q (872) | T399H (873) | V401N (874) | V401Q (875) | V401H (876) | S402N (877) |
| S402Q (878) | S402H (879) | V405N (880) | V405Q (881) | V405H (882) | I408N (883) | I408Q (884) |
| I408H (885) | T412N (886) | T412Q (887) | T412H (888) | T415N (889) | T415Q (890) | T415H (891) |
| L165Q (1025) | L165H (1026) | F175H (1027) | F178H (1028) | F192H (1029) | F192I (1030) | F192V (1031) |
| W194I (1032) | L198Q (1033) | L198H (1034) | | | | |

A modified, FIX polypeptide provided herein that exhibits increased protease resistance can contain one or more amino acid modifications corresponding to any one or more modifications of Y1H (i.e., replacement of Y by H at a position corresponding, to amino acid position 1 of mature human FIX (such as, SEQ ID NO: 2)), Y1I, S3Q, S3H, S3N, G4Q, G4H, G4N, K5N, K5Q, L6I, L6V, E7Q, E7H, E7N, E8Q, E8H, E8N, F9I, F9V, V10Q, V10H, V10N, G12Q, G12H, G12N, L14I, L14V, E15Q, E15H, E15N, R16H, R16Q, E17Q, E17H, E17N, M19I, M19V, E20Q, E20H, E20N, E21Q, E21H, E21N, K22N, K22Q, S24Q, S24H, S24N, F25I, F25V, E26Q, E26H, E26N, E27Q, E27H, E27N, A28Q, A28N, A28N, R29H, R29Q, E30Q, E30H, E30N, V31Q, V31H, V31N, F32I, F32V, E33Q, E33H, E33N, T35Q, T35H, T35N, E36Q, E36H, E36N, R37H, R37Q, T38Q, T38H, T38N, T39Q, T39H, T39N, E40Q, E40H, E40N, F41I, F41V, W42S, W42H, K43N, K43Q, Y45H, Y45I, V46Q, V46H, V46N, D47N, D47Q, G48Q, G48H, G48N, D49N, D49Q, E52Q, E52H, E52N, S53Q, S53H, S53N, P55A, P55S, L57I, L57V, N58Q, N58S, G59Q, G59H, G59N, G60Q, G60H, G60N, S61Q, S61H, S61N, K63N, K63Q, D64N, D64Q, D65N, D65Q, I66Q, I66H, I66N, S68Q, S68H, S68N, Y69H, Y691, E70Q, E70H, E70N, W72S, W72H, P74A, P74S, F751, F75V, G76Q, G76H, G76N, F77I, F77V, E78Q, E78H, E78N, G79Q, G79H, G79N, K80N, K80Q, E83Q, E83H, E83N, L841, L84V, D85N, D85Q, V86Q, V86H, V86N, T87Q, T87H, T87N, I90Q, I90H, I90N, K91N, K91Q, N92Q, N92S, G93Q, G93H, G93N, R94H, R94Q, E96Q, E96H, E96N, F98I, F98V, K100N, K100Q, S102Q, S102H, S102N, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L117I, L117V, A118Q, A118H, A118N, E119Q, E119H, E119N, K122N, K122Q, S123Q, S123H, S123N, E125Q, E125H, E125N, P126A, P126S, A127Q, A127H, A127N, V128Q, V128H, V128N, P129A, P129S, P131A, P131S, G133Q, G133H, G133N, R134H, R134Q, V135Q, V135H, V135N, S136Q, S136H, S136N, V137Q, V137H, V137N, S138Q, S138H, S138N, T140Q, T140H, T140N, S141Q, S141H, S141N, K142N, K142Q, L143I, L143V, T144Q, T144H, T144N, R145H, R145Q, A146Q, A146H, A146N, E147Q, E147H, E147N, T148Q, T148H, T148N, V149Q, V149H, V149N, P151A, P151S, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, D166N, D166Q, I168Q, I168H, I168N, T169Q, T169H, T169N, S171Q, S171H, S171N, T172Q, T172H, T172N, S174Q, S174H, S174N, F175I, F175V, F175H, D177N, D177Q, F178I, F178V, F178H, T179Q, T179H, T179N, R180H, R180Q, V181Q, V181H, V181N, V182Q, V182H, V182N, G183Q, G183H, G183N, G184Q, G184H, G184N, E185Q, E185H, E185N, D186N, D186Q, A187Q, A187H, A187N, K188H, K188N, P189A, P189S, G190Q, G190H, G190N, F192I, F192V, F192IH, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203N, D203Q, A204Q, A204H, A204N, F205I, F205V, G207Q, G207H, G207N, G208Q, G208H, G208N, S209Q, S209H, S209N, I210Q, I210H, I210N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, E224Q, E224H, E224N, T225Q, T225H, T225N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, T241Q, T241H, T241N, E242Q, E242H, E242N, T244Q, T244H, T244N, E245Q, E245H, E245N, K247N, K247Q, R248H, R248Q, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, E294Q, E294H, E294N, Y295H, Y295I, T296Q, T296H, T296N, I298Q, I298H, I298N, F299I, F299V, L300I, L300V, K301N, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316N, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332N, D332Q, R333H, R333Q, A334Q, A334H, A334N, T335Q, T335H, T335N, T337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351N, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, S365Q, S365H, S365N, G366Q, G366H, G366N, G367Q, G367H, G367N, P368A, P368S, V370Q, V370H, V370N, T371Q, T371H, T371N, E372Q, E372H, E372N, V373Q, V373H, V373N, E374Q, E374H, E374N, G375Q, G375H, G375N, T376Q, T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395N, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E410Q, E410H, E410N, K411N, K411Q, T412Q, T412H, T412N, K413N, K413Q, L414I, L414V, T415Q, T415H, and T415N, where the modified polypeptide exhibits increased resistance to proteolysis. In some examples, the modifications are in an unmodified FIX polypeptide, such as a FIX having a sequence of amino acids set forth in SEQ ID NO: 2. Exemplary modified FIX LEAD candidate polypeptides are set forth in any one of SEQ ID NOS: 3-891 or 1025-1034. In some examples, the modifications are in a FIX polypeptide, such as a FIX polypeptide having a sequence of amino acids set forth in SEQ ID NO: 892 or 1035. For example, exemplary modified FIX LEAD candidate polypeptides are set forth in any one of SEQ ID NOS: 1036-1926 or 2035-2044.

Additionally, a modified FIX polypeptide as set forth above can contain a further modification compared to an unmodified FIX polypeptide. Generally, the resulting modified FIX polypeptide retains one or more activities of the unmodified FIX polypeptide. In some embodiments, the modified FIX polypeptide inhibits the activity of an unmodified or wild-type FIX polypeptide and/or acts as an anticoagulant.

i. Modified FIX Polypeptides Exhibiting Increased Protease Resistance to Elastase Exemplary of modified FIX polypeptides exhibiting increased protease resistance are FIX polypeptides exhibiting increased resistance to elastase. Non-limiting modifications in a FIX polypeptide that confer increased resistance to elastase have been rationally determined herein based on the known substrate specificity of elastase. Polypeptides are cleaved by elastase at or near a sequence of small hydrophobic chains. Modifications that render polypeptides more resistant to hydrolysis by elastase are provided. Of the modifications disclosed in Table 5, some are more specific to resistance to protease digestion by elastase. The following is-HIT positions were identified to eliminate elastase sensitive sites and increase protein stability of FIX polypeptides: 3, 4, 10, 12, 24, 28, 31, 35, 38, 39, 46, 48, 53, 59, 60, 61, 66, 68, 76, 79, 86, 87, 90, 93, 102, 103, 107, 108, 110, 112, 114, 118, 123, 127, 128, 133, 135, 136, 137, 138, 140, 141, 144, 146, 148, 149, 153, 156, 158, 159, 161, 163, 164, 168, 169, 171, 172, 174, 179, 181, 182, 183, 184, 187, 190, 196, 197, 200, 202, 204, 207, 208, 209, 210, 211, 216, 217, 218, 219, 220, 223, 225, 226, 227, 229, 230, 231, 232, 233, 234, 238, 241, 244, 250, 251, 253, 254, 261, 262, 263, 270, 271, 280, 283, 285, 286, 288, 290, 291, 296, 298, 303, 304, 305, 307, 308, 309, 311, 313, 317, 319, 320, 322, 328, 331, 334, 335, 339, 340, 343, 344, 351, 352, 356, 357, 360, 363, 365, 366, 367, 370, 371, 373, 375, 376, 377, 380, 381, 382, 383, 384, 386, 390, 393, 396, 397, 399, 401, 402, 405, 408, 412, and 415, corresponding to amino acid positions in a mature FIX polypeptide set forth in SEQ ID NO: 2. Amino acid modifications can be at any one or more positions corresponding to any of the following positions: S3, G4, V10, G12, S24, A28, V31, T35, T38, T39, V46, G48, S53, G59, G60, S61, I66, S68, G76, G79, V86, T87, I90, G93, S102, A103, V107, V108, S110, T112, G114, A118, S123, A127, V128, G133, V135, S136, V137, S138, T140, S141, T144, A146, T148, V149, V153, V156, S158, T159, A161, T163, I164, I168, T169, S171, T172, S174, T179, V181, V182, G183, G184, A187, G190, V196, V197, G200, V202, A204, G207, G208, S209, I210, V211, I216, V217, T218, A219, A220, V223, T225, G226, V227, I229, T230, V231, V232, A233, G234, I238, T241, T244, V250, I251, I253, I254, A261, A262, I263, I270, A271, V280, S283, V285, T286, I288, I290, A291, T296, I298, G303, G304, G305, V307, S308, G309, G311, V313, G317, S319, A320, V322, V328, V331, A334, T335, S339, T340, T343, I344, A351, G352, G356, G357, S360, G363, S365, G366, G367, V370, T371, V373, G375, T376, S377, T380, G381, I382, I383, S384, G386, A390, G393, G396, I397, T399, V401, S402, V405, I408, T412, and T415, of a mature FIX polypeptide set forth in SEQ ID NO: 2. Other candidate Leads can be obtained by replacement or replacements of amino acids at is-HIT positions such as, but not limited to, amino acid modifications as described for candidate LEADs in Table 6. Candidate leads can be empirically tested to determine those that confer resistance to elastase. Table 6 provides non-limiting examples of amino acid modifications that are more specific to resistance to protease digestion by elastase and, thereby, increase protein stability. Generally, a resulting modified FIX polypeptide retains one or more activities of a mature or unmodified FIX polypeptide. In some embodiments, the modified FIX polypeptide inhibits an activity of an unmodified or wild-type FIX polypeptide and/or acts as an anticoagulant. In Table 6 below, the sequence identifier (SEQ ID NQ.) is in parenthesis next to each substitution.

TABLE 6

List of Human FIX Modifications to Increase Resistance to Elastase Proteolysis

| | | | | | | |
|---|---|---|---|---|---|---|
| S3N (403) | S3Q (404) | S3H (405) | G4N (406) | G4Q (407) | G4H (408) | V10N (409) |
| V10Q (410) | V10H (411) | G12N (412) | G12Q (413) | G12H (414) | S24N (415) | S24Q (416) |
| S24H (417) | A28N (418) | A28Q (419) | A28H (420) | V31N (421) | V31Q (422) | V31H (423) |
| T35N (424) | T35Q (425) | T35H (426) | T38N (427) | T38Q (428) | T38H (429) | T39N (430) |
| T39Q (431) | T39H (432) | V46N (433) | V46Q (434) | V46H (435) | G48N (436) | G48Q (437) |
| G48H (438) | S53N (439) | S53Q (440) | S53H (441) | G59N (442) | G59Q (443) | G59H (444) |
| G60N (445) | G60Q (446) | G60H (447) | S61N (448) | S61Q (449) | S61H (450) | I66N 451) |
| I66Q (452) | I66H (453) | S68N (454) | S68Q (455) | S68H (456) | G76N (457) | G76Q (458) |
| G76H (459) | G79N (460) | G79Q (461) | G79H (462) | V86N (463) | V86Q (464) | V86H (465) |
| T87N (466) | T87Q (467) | T87H (468) | I90N (469) | I90Q (470) | I90H (471) | G93N (472) |
| G93Q (473) | G93H (474) | S102N (475) | S102Q (476) | S102H (477) | A103N (478) | A103Q (479) |
| A103H (480) | V107N (481) | V107Q (482) | V107H (483) | V108N (484) | V108Q (485) | V108H (486) |
| S110N (487) | S110Q (488) | S110H (489) | T112N (490) | T112Q (491) | T112H (492) | G114N (493) |
| G114Q (494) | G114H (495) | A118N (496) | A118Q (497) | A118H (498) | S123N (499) | S123Q (500) |
| S123H (501) | A127N (502) | A127Q (503) | A127H (504) | V128N (505) | V128Q (506) | V128H (507) |
| G133N (508) | G133Q (509) | G133H (510) | V135N (511) | V135Q (512) | V135H (513) | S136N (514) |
| S136Q (515) | S136H (516) | V137N (517) | V137Q (518) | V137H (519) | S138N (520) | S138Q (521) |
| S138H (522) | T140N (523) | T140Q (524) | T140H (525) | S141N (526) | S141Q (527) | S141H (528) |
| T144N (529) | T144Q (530) | T144H (531) | A146N (532) | A146Q (533) | A146H (534) | T148N (535) |
| T148Q (536) | T148H (537) | V149N (538) | V149Q (539) | V149H (540) | V153N (541) | V153Q (542) |
| V153H (543) | V156N (544) | V156Q (545) | V156H (546) | S158N (547) | S158Q (548) | S158H (549) |
| T159N (550) | T159Q (551) | T159H (552) | A161N (553) | A161Q (554) | A161H (555) | T163N (556) |
| T163Q (557) | T163H (558) | I164N (559) | I164Q (560) | I164H (561) | I168N (562) | I168Q (563) |
| I168H (564) | T169N (565) | T169Q (566) | T169H (567) | S171N (568) | S171Q (569) | S171H (570) |
| T172N (571) | T172Q (572) | T172H (573) | S174N (574) | S174Q (575) | S174H (576) | T179N (577) |
| T179Q (578) | T179H (579) | V181N (580) | V181Q (581) | V181H (582) | V182N (583) | V182Q (584) |
| V182H (585) | G183N (586) | G183Q (587) | G183H (588) | G184N (589) | G184Q (590) | G184H (591) |
| A187N (592) | A187Q (593) | A187H (594) | G190N (595) | G190Q (596) | G190H (597) | V196N (598) |
| V196Q (599) | V196H (600) | V197N (601) | V197Q (602) | V197H (603) | G200N (604) | G200Q (605) |
| G200H (606) | V202N (607) | V202Q (608) | V202H (609) | A204N (610) | A204Q (611) | A204H (612) |
| G207N (613) | G207Q (614) | G207H (615) | G208N (616) | G208Q (617) | G208H (618) | S209N (619) |
| S209Q (620) | S209H (621) | I210N (622) | I210Q (623) | I210H (624) | V211N (625) | V211Q (626) |
| V211H (627) | I216N (628) | I216Q (629) | I216H (630) | V217N (631) | V217Q (632) | V217H (633) |
| T218N (634) | T218Q (635) | T218H (636) | A219N (637) | A219Q (638) | A219H (639) | A220N (640) |
| A220Q (641) | A220H (642) | V223N (643) | V223Q (644) | V223H (645) | T225N (646) | T225Q (647) |
| T225H (648) | G226N (649) | G226Q (650) | G226H (651) | V227N (652) | V227Q (653) | V227H (654) |
| I229N (655) | I229Q (656) | I229H (657) | T230N (658) | T230Q (659) | T230H (660) | V231N (661) |
| V231Q (662) | V231H (663) | V232N (664) | V232Q (665) | V232H (666) | A233N (667) | A233Q (668) |
| A233H (669) | G234N (670) | G234Q (671) | G234H (672) | I238N (673) | I238Q (674) | I238H (675) |
| T241N (676) | T241Q (677) | T241H (678) | T244N (679) | T244Q (680) | T244H (681) | V250N (682) |
| V250Q (683) | V250H (684) | I251N (685) | I251Q (686) | I251H (687) | I253N (688) | I253Q (689) |
| I253H (690) | I254N (691) | I254Q (692) | I254H (693) | A261N (694) | A261Q (695) | A261H (696) |
| A262N (697) | A262Q (698) | A262H (699) | I263N (700) | I263Q (701) | I263H (702) | I270N (703) |
| I270Q (704) | I270H (705) | A271N (706) | A271Q (707) | A271H (708) | V280N (709) | V280Q (710) |
| V280H (711) | S283N (712) | S283Q (713) | S283H (714) | V285N (715) | V285Q (716) | V285H (717) |
| T286N (718) | T286Q (719) | T286H (720) | I288N (721) | I288Q (722) | I288H (723) | I290N (724) |
| I290Q (725) | I290H (726) | A291N (727) | A291Q (728) | A291H (729) | T296N (730) | T296Q (731) |

TABLE 6-continued

List of Human FIX Modifications to Increase Resistance to Elastase Proteolysis

T296H (732)  I298N (733)  I298Q (734)  I298H (735)  G303N (736)  G303Q (737)  G303H (738)
S304N (739)  S304Q (740)  S304H (741)  G305N (742)  G305Q (743)  G305H (744)  V307N (745)
V307Q (746)  V307H (747)  S308N (748)  S308Q (749)  S308H (750)  G309N (751)  G309Q (752)
G309H (753)  G311N (754)  G311Q (755)  G311H (756)  V313N (757)  V313Q (758)  V313H (759)
G317N (760)  G317Q (761)  G317H (762)  S319N (763)  S319Q (76)   S319H (765)  A320N (766)
A320Q (767)  A320H (768)  V322N (769)  V322Q (770)  V322H (771)  V328N (772)  V328Q (773)
V328H (774)  V331N (775)  V331Q (776)  V331H (777)  A334N (778)  A334Q (779)  A334H (780)
T335N (781)  T335Q (782)  T335H (783)  S339N (784)  S339Q (785)  S339H (786)  T340N (787)
T340Q (788)  T340H (789)  T343N (790)  T343Q (791)  T343H (792)  I344N (793)  I344Q (794)
I344H (795)  A351N (796)  A351Q (797)  A351H (798)  G352N (799)  G352Q (800)  G352H (801)
G356N (802)  G356Q (803)  G356H (804)  G357N (805)  G357Q (806)  G357H (807)  S360N (808)
S360Q (809)  S360H (810)  G363N (811)  G363Q (812)  G363H (813)  S365N (814)  S365Q (815)
S365H (816)  G366N (817)  G366Q (818)  G366H (819)  G367N (820)  G367Q (821)  G367H (822)
V370N (823)  V370Q (824)  V370H (825)  T371N (826)  T371Q (827)  T371H (828)  V373N (829)
V373Q (830)  V373H (831)  G375N (832)  G375Q (833)  G375H (834)  T376N (835)  T376Q (836)
T376H (837)  S377N (838)  S377Q (839)  S377H (840)  T380N (841)  T380Q (842)  T380H (843)
G381N (844)  G381Q (845)  G381H (846)  I382N (847)  I382Q (848)  I382H (849)  I383N (850)
I383Q (851)  I383H (852)  S384N (853)  S384Q (854)  S384H (855)  G386N (856)  G386Q (857)
G386H (858)  A390N (859)  A390Q (860)  A390H (861)  G393N (862)  G393Q (863)  G393H (864)
G396N (865)  G396Q (866)  G396H (867)  I397N (868)  I397Q (869)  I397H (870)  T399N (871)
T399Q (872)  T399H (873)  V401N (874)  V401Q (875)  V401H (876)  S402N (877)  S402Q (878)
S402H (879)  V405N (880)  V405Q (881)  V405H (882)  I408N (883)  I408Q (884)  I408H (885)
T412N (886)  T412Q (887)  T412H (888)  T415N (889)  T415Q (890)  T415H (891)

A modified FIX polypeptide provided herein that exhibits increased protease resistance to elastase can contain one or more amino acid modifications corresponding to modifications selected from any of S3Q, S3H, S3N, G4Q, G4H, G4N, V10Q, V10H, V10N, G12Q, G12H, G12N, S24Q, S24H, S24N, A28Q, A28H, A28N, V31Q, V31H, V31N, T35' Q, T35H, T35N, T38Q, T38H, T38N, T39Q, T39H, T39N, V46Q, V46H, V46N, G48Q, G48H, G48N, S53Q, S53H, S53N, G59Q, G59H, G59N, G60Q, G60H, G60N, S61Q, S61H, S61N, I66Q, I66H, I66N, S68Q, S68H, S68N, G76Q, G76H, G76N, G79Q, G79H, G79N, V86Q, V86H, V86N, T87Q, T87H, T87N, I90Q, I90H, I190N, G93Q, G93H, G93N, S102Q, S102H, S102N; A103Q, A103H, A103N, V107Q, V107H, V107N, V108Q, V108H; V108N, S110Q, S110H, S110N, T112Q, T112H, T112N, G114Q, G114H, G114N, A118Q, A118H, A118N, S123Q, S123H, S123N, A127Q, A127H, A127N, V128Q, V128H, V128N, G133Q, G133H, G133N, V135Q, V135H, V135N, S136Q, S136H, S136N, V137Q, V137H, V137N, S138Q, S138H, S138N, T140Q, T140H, T140N, S141Q, S141H, S141N, T144Q, T144H, T144N, A146Q, A146H, A146N, T148Q, T148H, T148N, V149Q, V149H, V149N, V153Q, V153H, V153N, V156Q, V156H, V156N, S158Q, S158H, S158N, T159Q, T159H, T159N, A161Q, A161H, A161N, T163Q, T163H, T163N, I164Q, I164H, I164N, I168Q, I168H, I168N, T169Q, T169H, T169N, S171Q, S171H, S171N, T172Q, T172H, T172N, S174Q, S174H, S174N, T179Q, T179H, T179N, V181Q, V181H, V181N, V182Q, V182H, V182N, G183Q, G183H, G183N, G184Q, G184H, G184N, A187Q, A187H, A187N, G190Q, G190H, G190N, V196Q, V196H, V196N, V197Q, V197H, V197N, G200Q, G200H, G200N, V202Q, V202H, V202N, A204Q, A204H, A204N, G207Q, G207H, G207N, G208Q, G208H, G208N, S209Q, S209H, S209N, I210Q, I210H, I210N, V211Q, V211H, V211N, I216Q, I216H, I216N, V217Q, V217H, V217N, T218Q, T218H, T218N, A219Q, A219H, A219N, A220Q, A220H, A220N, V223Q, V223H, V223N, T225Q, T225H, T225N, G226Q, G226H, G226N, V227Q, V227H, V227N, I229Q, I229H, I229N, T230Q, T230H, T230N, V231Q, V231H, V231N, V232Q, V232H, V232N, A233Q, A233H, A233N, G234Q, G234H, G234N, I238Q, I238H, I238N, T241Q, T241H, T241N, T244Q, T244H, T244N, V250Q, V250H, V250N, I251Q, I251H, I251N, I253Q, I253H, I253N, I254Q, I254H, I254N, A261Q, A261H, A261N, A262Q, A262H, A262N, I263Q, I263H, I263N, I270Q, I270H, I270N, A271Q, A271H, A271N, V280Q, V280H, V280N, S283Q, S283H, S283N, V285Q, V285H, V285N, T286Q, T286H, T286N, I288Q, I288H, I288N, I290Q, I290H, I290N, A291Q, A291H, A291N, T296Q, T296H, T296N, I298Q, I298H, I298N, G303Q, G303H, G303N, S304Q, S304H, S304N, G305Q, G305H, G305N, V307Q, V307H, V307N, S308Q, S308H, S308N, G309Q, G309H, G3Q9N, G311Q, G311H, G311N, V313Q, V313H, V313N, G317Q, G317H, G317N, S319Q, S319H, S319N, A320Q, A320H, A320N, V322Q, V322H, V322N, V328Q, V328H, V328N, V331Q, V331H, V331N, A334Q, A334H, A334N, T335Q, T335H, T335N, S339Q, S339H, S339N, T340Q, T340H, T340N, T343Q, T343H, T343N, I344Q, I344H, I344N, A351Q, A351H, A351N, G352Q, G352H, G352N, G356Q, G356H, G356N, G357Q, G357H, G357N, S360Q, S360H, S360N, G363Q, G363H, G363N, S365Q, S365H, S365N, G366Q, G366H, G366N, G367Q, G367H, G367N, V370Q, V370H, V370N, T371Q, T371H, T371N, V373Q, V373H, V373N, G375Q, G375H, G375N, T376Q, T376H, T376N, S377Q, S377H, S377N, T380Q, T380H, T380N, G381Q, G381H, G381N, I382Q, I382H, I382N, I383Q, I383H, I383N, S384Q, S384H, S384N, G386Q, G386H, G386N, A390Q, A390H, A390N, G393Q, G393H, G393N, G396Q, Q396H, G396N, I397Q, I397H, I397N, T399Q, T399H, T399N, V401Q, V401H, V401N, S402Q, S402H, S402N, V405Q, V405H, V405N, I408Q, I408H, I408N, T412Q, T412H, T412N, T415Q, T415H, T415N of a mature FIX polypeptide set forth in SEQ ID NO: 2. In some examples, the modifications are in a FIX polypeptide having a sequence of amino acids set forth in SEQ ID NO: 2. Exemplary modified FIX candidate LEAD polypeptides are set forth in any one of SEQ ID NOS: 3-891 or 1025-1034. In some examples, the modifications are in a FIX polypeptide, such as a FIX polypeptide having a sequence of amino acids set forth in SEQ ID NO: 892 or 1035. For example, exemplary modified FIX LEAD candidate polypeptides are set forth in any one of SEQ ID NOS: 1036-1926 or 2035-2044.

e. Assessment of FIX Variants with Increased Resistance to Proteolysis

Increased resistance to proteolysis of FIX variants can be assessed by any methods known in the art to assess protein stability, thermal tolerance, protease sensitivity and resistance and/or FIX activity. In one example, protease resistance is measured by incubating a modified FIX polypeptide with one or more proteases and then assessing residual activity compared to an untreated control. A modified FIX can be compared with an unmodified and/or wild-type native FIX treated under similar conditions to determine if the particular variant retains more activity than the unmodified FIX. Activity can be assessed by any methods known in the art, for example by measuring coagulation activities.

Kinetic studies of protease resistance also can be used to assess a modified FIX polypeptide. For example, a modified FIX polypeptide is incubated with one or more proteases and samples are taken over a series of time-points. At each time point, the proteases are inactivated and the samples are then tested for FIX activity. In one embodiment, the modified polypeptide is at least about or 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more resistant to proteolysis.

In one exemplary embodiment, FIX variants are assessed for protease resistance with a mixture of proteases and proteolytic conditions including pepsin, trypsin, chymotrypsin, elastase, aminopeptidase, gelatinase B, gelatinase A, α-chymotrypsin, carboxypeptidase, endoproteinase Arg-C, endoproteinase Asp-N, endoproteinase Glu-C, endoproteinase Lys-C, luminal pepsin, microvillar endopeptidase, dipeptidyl peptidase, enteropeptidase, hydrolase, NS3, factor Xa, Granzyme B, thrombin, plasmin, urokinase, tPA and PSA. For example, a cytopathic effects (CPE) assay can be used to assess coagulation activity of modified FIX polypeptides compared to unmodified FIX polypeptides. Specifically, coagulation activity of FIX can determined by the capacity of the modified FIX polypeptides to induce formation of a clot in an assay, such as an activated partial thromboplastin time assay. The resistance of the modified FIX polypeptides compared to wild-type FIX against enzymatic cleavage can be analyzed by mixing FIX polypeptides with proteases. After exposure to proteases, coagulation activities can be assessed.

In one example, activity of modified hFIX is assessed in an assay by measuring the capacity of the modified hFIX to modulate coagulation when added to the sample. Prior to the measurement of activity, hFIX molecules can be challenged with proteases (blood, intestinal, etc.) including conditions mimicking administered conditions, such as serum, blood, saliva, or digestive assays (in vitro assays), and/or administered to a subject such as a mouse or human (in vivo assays) during different incubation or post-injection times. The activity measured, corresponds then to the residual activity following exposure to the proteolytic mixtures. Activity can be compared with an unmodified FIX as a measurement of the effect of the modification on protease stability and on the activity. In one example, the unmodified FIX is a wild-type native FIX. In another example, the unmodified FIX is a variant form of FIX that was used as a starting material to introduce further modifications. Modified FIX polypeptides also can be compared with any known FIX polypeptide in any assay known in the art to compare protease sensitivity, thermal tolerance and/or any other activity.

2. Super-LEADs

Modification of FIX polypeptides also can include combining two or more modifications as set forth above. Modified FIX super-LEAD polypeptides are a combination of single amino acid mutations present in two or more of the respective modified FIX LEAD polypeptides. Thus, modified FIX super-LEAD polypeptides have two or more of the single amino acid replacements derived from two or more of the respective modified FIX LEAD polypeptides. As described above and in detail below, modified FIX polypeptides provided herein exhibit increased protein stability manifested as an increased resistance to proteolysis. Typically, modified FIX LEAD polypeptides created are those whose performance has been optimized with respect to the unmodified polypeptide by modification of a single amino acid replacement at one is-HIT position. Modified FIX super-Lead polypeptides are created such that the polypeptide contains two or more FIX LEAD modifications, each at a different is-HIT position. Modifications that increase proteolysis resistance can be added to other modifications provided herein or known in the art to increase proteolysis resistance. In one example, modifications that increase stability can be added to other modifications provided herein or known in the art to increase protein stability. In another example, modifications that increase stability can be added to modifications provided herein or known in the art to increase proteolysis resistance. Modifications that increase protease resistance and/or stability also can be added to modifications to FIX that alter other functionalities including activity, modifications that affect post-translation protein modifications and any other known modifications in the art.

Once the modified LEAD polypeptides have been identified using, for example, 2D-scanning methods, super-LEADs can be generated by combining two or more individual LEADs using methods well known in the art, such as recombination, mutagenesis and DNA shuffling, and by methods such as additive directional mutagenesis, 3D-scanning, and multi-overlapped primer extensions, as provided above.

Exemplary modified FIX super-LEAD polypeptides exhibiting increased protein stability can include FIX polypeptides containing two or more amino acid modifications as compared to an unmodified FIX polypeptide. In some examples, a FIX polypeptide can contain 2, 3, 4, 5, 6, 7, 8, 9, 10, 11, 12, 13, 14, 15, 16, 17, 18, 19, or more modified positions. Generally, the resulting FIX polypeptide exhibits increased protein stability and retains at least one activity of an unmodified FIX polypeptide. A modified FIX polypeptide can include any two or more amino acid modifications set forth in Table 5 above. For example, the modified FIX polypeptide can contain two or more amino acid modifications corresponding to any two or more modifications of Y1I, S3Q, S3H, S3N, G4Q, G4H, G4N, K5N, K5Q, L6I, L6V, E7Q, E7H, E7N, E8Q, E8H, E8N, F9I, F9V, V10Q, V10H, V10N, G12Q, G12H, G12N, L14I, L14V, E15Q, E15H, E15N, R16H, R16Q, E17Q, E17H, E17N, M19I, M19V, E20Q, E20H, E20N, E21Q, E21H, E21N, K22N, K22Q, S24Q, S24H, S24N, F25I, F25V, E26Q, E26H, E26N, E27Q, E27H, E27N, A28Q, A28H, A28N, R29H, R29Q, E30Q, E30H, E30N, V31Q, V31H, V31N, F32I, F32V, E33Q, E33H, E33N, T35Q, T35H, T35N, E36Q, E36H, E36N, R37H, R37Q, T38Q, T38H, T38N, T39Q, T39H, T39N, E40Q, E40H, E40N, F41I, F41V, W42S, W42H, K43N, K43Q, Y45H, Y45I, V46Q, V46H, V46N, D47N, D47Q, G48Q, G48H, G48N, D49N, D49Q, E52Q, E52H, E52N, S53Q, S53H, S53N, P55A, P55S, L57I, L57V, N58Q, N58S, G59Q, G59H, G59N, G60Q, G60H, G60N, S61Q, S61H, S61N, K63N, K63Q, D64N, D64Q, D65N, D65Q, I66Q, I66H, I66N, S68Q, S68H, S68N, Y69H, Y69I, E70Q, E70H, E70N, W72S, W72H, P74A, P74S, F75I, F75V, G76Q, G76H, G76N, F77I, F77V, E78Q, E78H, E78N, G79Q, G79H, G79N, K80N, K80Q, E83Q, E83H, E83N, L84I, L84V, D85N, D85Q, V86Q, V86H, V86N, T87Q, T87H, T87N, I90Q, I90H, I90N, K91N, K91Q, N92Q, N92S, G93Q, G93H, G93N, R94N, R94Q, E96Q, E96H, E96N, F98I, F98V, K100N, K100Q, S102Q, S102H, S102N, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L117I, L117V, A118Q, A118H, A118N, E119Q, E119H, E119N, K122N, K122Q, S123Q, S123H, S123N, E125Q, E125H, E125N, P126A, P126S, A127Q, A127H, A127N, V128Q, V128H, V128N, P129A, P129S, P131A, P131S, G133Q, G133H, G133N, R134H, R134Q, V135Q, V135H, V135N, S136Q, S136H, S136N, V137Q, V137H, V137N, S138Q, S138H, S138N, T140Q, T140H, T140N, S141Q, S141H, S141N, K142N, K142Q, L143I, L143V, T144Q, T144H, T144N, R145H, R145Q, A146Q, A146H, A146N, E147Q, E147H, E147N, T148Q, T148H, T148N, V149Q, V149H, V149N, P151A, P151S, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, D166N, D166Q, I168Q, I168H, I168N, T169Q, T169H, T169N, S171Q, S171H, S171N, T172Q, T172H, T172N, S174Q, S174H, S174N, F175I, F175V, F175H, D177N, D177Q, F178I, F178V, F178H, T179Q, T179H, T179N, R180H, R180Q, V181Q, V181H, V181N, V182Q, V182H, V182N, G183Q, G183H, G183N, G184Q, G184H, G184N, E185Q, E185H, E185N, D186N, D186Q, A187Q, A187H, A187N, K188N, K188Q, P189A, P189S, G190Q, G190H, G190N, F192I, F192V, F192IH, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203N, D203Q, A204Q, A204H, A204N, F205I, F205V, G207Q, G207H, G207N, G208Q, G208H, G208N, S209Q, S209H, S209N, I210Q, I210H, I210N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, E224Q, E224H, E224N, T225Q, T225H, T225N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, T241Q, T241H, T241N, E242Q, E242H, E242N, T244Q, T244H, T244N, E245Q, E245H, E245N, K247N, K247Q, R248H, R248Q, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, E294Q, E294H, E294N, Y295H, Y295I, T296Q, T296H, T296N, I298Q, I298H, I298N, F299I, F299V, L300I, L300V, K301N, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316N, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332N, D332Q, R333H, R333Q, A334Q, A334H, A334N, T335Q, T335H, T335N, L337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351N, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, S365Q, S365H, S365N, G366Q, G366H, G366N, G367Q, G367H, G367N, P368A, P368S, V370Q, V370H, V370N, T371Q, T371H, T371N, E372Q, E372H, E372N, V373Q, V373H, V373N, E374Q, E374H, E374N, G375Q, G375H, G375N, T376Q, T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395H, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E410Q, E410H, E410N, K411N, K411Q, T412Q, T412H, T412N, K413N, K413Q, L414I, L414V, T415Q, T415H, and T415N of a mature FIX polypeptide set forth in SEQ ID NO: 2. In some examples, the modifications are in an unmodified FIX polypeptide having a sequence of amino acids set forth in SEQ ID NO: 2. Provided herein are modified FIX Super-LEAD polypeptides containing two or more amino acid modifications and exhibiting increased protein stability having a sequence of amino acids set forth in any of SEQ ID NOS: 917-1024. In some examples, the modifications are in a FIX polypeptide, such as a FIX polypeptide having a sequence of amino acids set forth in SEQ ID NO: 892 or 1035. For example, exemplary modified FIX LEAD candidate polypeptides are set forth in any one of SEQ ID NOS: 1927-2034.

In one non-limiting example, a FIX polypeptide can contain a modification at a position corresponding to F192I of a mature FIX polypeptide set forth in SEQ ID NO: 2, and can contain further amino acid modifications, such as any modification set forth in Table 5. Exemplary super-LEAD FIX polypeptides are set forth in Table 7 with the sequence identifier (SEQ ID NO.) in parenthesis next to each substitution. Resulting super-LEADs can be tested for one or more parameters to assess protein stability (such as, increased resistance to proteases) using any of the assays described herein, such as is described in the Examples.

TABLE 7

Exemplary Modified FIX Super-LEADs to Increase Protein Stability

| | | | |
|---|---|---|---|
| T163H/F192I (917) | I164Q/F192I (918) | T169H/F192I (919) | S171Q/F192I (920) |
| D152N/D154N/F192I (921) | S174Q/F192I (922) | S174H/F192I (923) | T179Q/F192I (924) |
| T179H/F192I (925) | T163N/I164N/F192I (926) | D166Q/F192I (927) | D166N/F192I (928) |
| D186Q/F192I (929) | D186N/F192I (930) | T148A/D152N/D152N/F192I (934) | D154N/F192I (931) |
| F192I/D203Q (932) | F192I/D203N (933) | D154N/F192I (937) | D152Q/F192I (935) |
| T148A/D152N/T163N/I164N (939) | F192I (936) | V196N/V197N (941) | D154Q/F192I (938) |
| F175I/F178I (943) | A187N/G190N (940) | T148A/D152N (945) | T140N/T144N (942) |
| T148A/D154N (947) | F192I/W194I (944) | D152N/D154N (949) | T148A/D152Q (946) |
| | T148A/D154Q (948) | | I168N/T169N/S171N/T172N/S174N (950) |
| T179N/V181N/V182N/G183N/G184N (951) | D152N/D154N/T148A (952) | T163H/D166Q/F192I (953) | T163H/D166N/F192I (954) |
| T163H/D186Q/F192I (955) | T163H/D186N/F192I (956) | T163H/F192I/D203Q (957) | T163H/F192I/D203N (958) |
| T148A/D152N/D154N/T163H/F192I (959) | T148A/D154N/T163H/F192I (960) | I164Q/D166Q/F192I (961) | I164Q/D166N/F192I (962) |
| I164Q/D186Q/F192I (963) | I164Q/D186N/F192I (964) | I164Q/F192I/D203Q (965) | I164Q/F192I/D203N (966) |
| T148A/D152N/D154N/I164Q/F192I (967) | T148A/D154N/I164Q/F192I (968) | T163N/I164N/D166Q/F192I (969) | T163N/I164N/D166N/F192I (970) |
| T163N/I164N/D186Q/F192I (971) | T163N/I164N/D186N/F192I (972) | T163N/I164N/F192I/D203Q (973) | T163N/I164N/F192I/D203N (974) |
| T148A/D152N/D154N/T163N/I164N/F192I (975) | T148A/D154N/T163N/I164N/F192I (976) | D166Q/T169H/F192I (977) | D166N/T169H/F192I (978) |
| T169H/D186Q/F192I (979) | T169H/D186N/F192I (980) | T169H/F192I/D203Q (981) | T169H/F192I/D203N (982) |
| T148A/D152N/D154N/T169H/F192I (983) | T148A/D154N/T169H/F192I (984) | D166Q/S171Q/F192I (985) | D166N/S171Q/F192I (986) |
| S171Q/D186Q/F192I (987) | S171Q/D186N/F192I (988) | S171Q/F192I/D203Q (989) | S171Q/F192I/D203N (990) |
| T148A/D152N/D154N/S171Q/F192I (991) | T148A/D154N/S171Q/F192I (992) | D166Q/S174Q/F192I (993) | D166N/S174Q/F192I (994) |
| S174Q/D186Q/F192I (995) | S174Q/D186N/F192I (996) | S174Q/F192I/D203Q (997) | S174Q/F192I/D203N (998) |
| T148A/D152N/D154N/S174Q/F192I (999) | T148A/D154N/S174Q/F192I (1000) | D166Q/S174H/F192I (1001) | D166N/S174H/F192I (1002) |
| S174H/D186Q/F192I (1003) | S174H/D186N/F192I (1004) | S174H/F192I/D203Q (1005) | S174H/F192I/D203N (1006) |
| T148A/D152N/D154N/S174H/F192I (1007) | T148A/D154N/S174H/F192I (1008) | D166Q/T179Q/F192I (1009) | D166N/T179Q/F192I (1010) |
| T179Q/D186Q/F192I (1011) | T179Q/D186N/F192I (1012) | T179Q/F192I/D203Q (1013) | T179Q/F192I/D203N (1014) |
| T148A/D152N/D154N/T179Q/F192I (1015) | T148A/D154N/T179Q/F192I (1016) | D166Q/T179H/F192I (1017) | D166N/T179H/F192I (1018) |
| T179H/D186Q/F192I (1019) | T179H/D186N/F192I (1020) | T179H/F192I/D203Q (1021) | T179H/F192I/D203N (1022) |
| T148A/D152N/D154N/T179H/F192I (1023) | T148A/D154N/T179H/F192I (1024) | | |

Non-limiting examples of FIX SuperLEAD polypeptides containing two or more amino acid modifications and exhibiting increased resistance to proteolysis can include amino acid replacements at amino acid residues corresponding to T163H/F192I, I164Q/F192I, T169H/F192I, S171Q/F192I, D152N/D154N/F192I, S174Q/F192I, S174H/F192I, T179Q/F192I, T179H/F192I, T163N/I164N/F192I, D166Q/F192I, D166N/F192I, D186Q/F192I, D186N/F192I, T148A/D152N/D154N/F192I, F192I/D203Q, F192I/D203N, D152N/F192I, D152Q/F192I, T148A/D154N/F192I, D154N/F192I, D154Q/F192I, T163N/I164N, A187N/G190N, V196N/V197N, T140N/T144N, F175I/F178I, F192I/W194I, T148A/D152N, T148A/D152Q, T148A/D154N, T148A/D154Q, D152N/D154N, I168N/T169N/S171N/T172N/S174N, T179N/V181N/V182N/G183N/G184N, D152N/D154N/T148A, T163H/D166Q/F192I, T163H/D166N/F192I, T163H/D186Q/F192I, T163H/D186N/F192I, T163H/F192I/D203Q, T163H/F192I/D203N, T148A/D152N/D154N/T163H/F192I, T148A/D154N/T163H/F192I, I164Q/D166Q/F192I, I164Q/D166N/F192I, I164Q/D186Q/F192I, I164Q/D186N/F192I, I164Q/F192I/D203Q, I164Q/F192I/D203N, T148A/D152N/D154N/I164Q/F192I, T148A/D154N/I164Q/F192I, T163N/I164N/D166Q/F192I, T163N/I164N/D166N/F192I, T163N/I164N/D186Q/F192I, T163N/I164N/D186N/F192I, T163N/I164N/F192I/D203Q, T163N/I164N/F192I/D203N, T148A/D152N/D154N/T163N/I164N/F192I, T148A/D154N/T163N/I164N/F192I, D166Q/T169H/F192I, D166N/T169H/F192I, T169H/D186Q/F192I, T169H/D186N/F192I, T169H/F192I/D203Q, T169H/F192I/D203N, T148A/D152N/D154N/T169H/F192I, T148A/D154N/T169H/F192I, D166Q/S171Q/F192I, D166N/S171Q/F192I, S171Q/D186Q/F192I, S171Q/D186N/F192I, S171Q/F192I/D203Q, S171Q/F192I/D203N, T148A/D152N/D154N/S171Q/F192I, T148A/D154N/S171Q/F192I, D166Q/S174Q/F192I, D166N/S174Q/F192I, S174Q/D186Q/F192I, S174Q/D186N/F192I, S174Q/F192I/D203Q, S174Q/F192I/D203N, T148A/D152N/D154N/S174Q/F192I, T148A/D154N/S174Q/F192I, D166Q/S174H/F192I, D166N/S174H/F192I, S174H/D186Q/F192I, S174H/D186N/F192I, S174H/F192I/D203Q, S174H/F192I/D203N, T148A/D152N/D154N/S174H/F192I, T148A/D154N/

S174H/F192I, D166Q/T179Q/F192I, D166N/T179Q/F192I, T179Q/D186Q/F192I, T179Q/D186N/F192I, T179Q/F192I/ D203Q, T179Q/F192I/D203N, T148A/D152N/D154N/ T179Q/F192I, T148A/D154N/T179Q/F192I, D166Q/ T179H/F192I, D166N/T179H/F192I, T179H/D186Q/F192I, T179H/D186N/F192I, T179H/F192I/D203Q, T179H/F192I/ D203N, T148A/D152N/D154N/T179H/F192I, and T148A/ D154N/T179H/F192I of a mature FIX polypeptide set forth in SEQ ID NO: 2 or 1035. Exemplary modified FIX Super-LEAD polypeptides containing two or more amino acid modifications and exhibiting increased protease resistance have a sequence of amino acids set forth in any one of SEQ ID NOS: 917-1024 or 1927-2034.

3. Other FIX Modifications

In addition to any one or more amino acid modifications provided herein, a modified FIX polypeptide also can contain one or more other modifications, including those known to those of skill in the art, such as PEGylation, hyperglycosylation, deimmunization and others (see such as U.S. Pat. Nos. 6,277,618, 6,315,995, and 6,531,298 and U.S. Patent Publication Nos. 2004-0102388, 2004-0110675, 2004-0254106, 2005-0100982, and 2006-0040856). Generally, the modification results in increased stability without losing at least one activity, such as blood coagulation activity (i.e. retains at least one activity as defined herein) of an unmodified FIX polypeptide. For example, other further modifications in a FIX polypeptide include one or more additional amino acid modifications and/or one or more chemical modifications. Such modifications include, but are not limited to, those that alter the immunogenicity, glycosylation, activity, or any other known property of a FIX polypeptide. In another example, chemical modifications include post-translational modifications of a protein, such as for example, glycosylation by a carbohydrate moiety; acylation; methylation; phosphorylation; sulfation; prenylation; Vitamin C-dependent modifications such as for example, proline, aspartic acid, lysine hydroxylations and carboxy terminal amidation; Vitamin K-dependent modifications such as for example, carboxylation of glutamic acid residues (i.e. gla residue); and incorporation of selenium to form a selenocysteine. Other protein modifications of a FIX polypeptide include PEGylation. In addition, protein modifications also can include modification to facilitate the detection, purification and assay development of a polypeptide, such as for example, modification of a polypeptide with a Sulfo-NHS-LC-biotin for covalent attachment to a primary amine on a protein, or other similar modification for florescent, non-isotopic or radioactive labels. Exemplary further modifications in a FIX polypeptide are described below. Modified polypeptides that are conjugates and/or labeled also are provided. For example, provided herein are modified polypeptides that are conjugated to a PEG moiety or contain a carbohydrate moiety covalently linked to one or more glycosylation sites on the polypeptide.

In another embodiment, other known properties of a FIX polypeptide can be modified in addition to any one or more amino acid modifications provided herein. Such modifications include, but are not limited to, alteration of the peptidase activity, coagulant activity, esterase activity, protein binding activities (such as FVIII), cofactor binding activities, such as $Ca^{2+}$, phospholipid or cell surface binding activities, and increased resistance to inhibitors, such as heparin and warfarin. Resulting modified FIX polypeptides can be tested for one or more parameters to assess polypeptide properties, such as protein stability (such as, increased resistance to proteases), or polypeptide activities, such as coagulant activity, using any of the assays described herein.

In yet another embodiment, known properties of a FIX polypeptide, as mentioned above, can be modified by generation of chimeric FIX polypeptides, in which all, or portions thereof, of FIX polypeptide domains are replaced by homologous domains of other coagulation factor family members. Such chimeric proteins are known in the art and can be combined with the methods for modification of FIX polypeptides provided herein (International PCT application No. WO 2006/018204 A1, Lin et al. (1990) J. Biol. Chem. 265(1):144-150 and Cheung et al. (1991) J. Biol. Chem. 266(14):8797-880). An exemplary chimeric protein has a sequence of amino acids as set forth in SEQ ID NO: 1035.

a. Immunogenicity

There are many instances where the efficacy of a therapeutic protein is limited by an unwanted immune reaction to the therapeutic protein. An immune response to a therapeutic protein, such as FIX, proceeds via the MHC class II peptide presentation pathway. Here, exogenous proteins are engulfed and processed for presentation in association with MHC class II molecules of the DR, DQ or DP type. MHC class II molecules are expressed by professional antigen presenting cells (APCs), such as macrophages and dendritic cells, amongst others. Engagement of a MHC class II peptide complex by a cognate T-cell receptor on the surface of the T cell, together with the cross binding of certain other co-receptors, such as the CD4 molecule, can induce an activated state within the T cell. Activation leads to the release of cytokines, further activating other lymphocytes such as B cells to produce antibodies or activating T killer cells as a full cellular immune response.

The ability of a peptide (T cell epitope) to bind a given MHC class II molecule for presentation on the surface of an APC is dependent on a number of factors, most notably its primary sequence. This will influence its propensity for proteolytic cleavage and also its affinity for binding within the peptide binding cleft of the MHC class II molecule. The MHC class II/peptide complex on the APC surface presents a binding face to a particular T cell receptor (TCR) able to recognize determinants provided by exposed residues of the peptide and the MHC class II molecule.

Formation of inhibitory antibodies to therapeutic FIX polypeptides is known in the art (Herzog et al. (2004) Semin. Thromb. Hemost. 30(2): 215-226). Hence, the combination modified FIX polypeptides provided herein with modifications to decrease overall immunogenicity of the modified FIX polypeptides can improve the therapeutic properties of the FIX polypeptide. The identification of T cell epitopes can be carried out according to methods known in the art (see such as, U.S. Patent Publication No. 20040254106) and can be used to identify the binding propensity of FIX peptides to an MHC class II molecule.

Further modifications to a modified FIX polypeptide provided herein can include modifications of at least one amino acid residue resulting in a substantial reduction in activity of or elimination of one or more T cell epitopes from the protein, i.e. deimmunization of the polypeptide. One or more amino acid modification at particular positions within any of the MHC class II ligands can result in a deimmunized FIX polypeptide with a reduced immunogenic when administered as a therapeutic to a host, such as for example, a human host.

Exemplary amino acid positions for modification of a T cell epitope, and thereby a deimmunized FIX polypeptide with a reduced immunogenic potential, include amino acid modifications at one or more positions corresponding to any of the following positions: Y1, S3, L6, F9, V10, Q11, G12, N13, L14, E15, R16, E17, C18, M19, E20, E21, K22, S24, F25, E26, E27, A28, R29, E30, V31, F32, E33, T35, F41, W42, K43, Q44, Y45, V46, D47, G48, D49, Q50, C51, E52, S53, N54, L57, G60, C62, K63, D65, I66, Y69, C71, W72, F75, F77, L84, V86, I90, K91, N92, G93, R94, C95, E96, Q97, F98, K100, N101, A103, D104, K106, V107, V108, V108, S110, C111, T112, E113, G114, Y115, R116, L117, A118, N120, Q121, S123, V128, F130, V135, V137, S138, T140, S141, K142, L143, R145, A146, T148, V149, F150, D152, V153, D154, Y155, V156, N157, S158, T159, E160, A161, E162, T163, I164, L165, I168, F175, F178, T179, R180, V181, V182, G183, G184, E185, D186, A187, K188, G190, F192, W194, Q195, V196, V197, L198, N199, G200, K201, V202, D203, A204, F205, G207, G208, S209, I210, V211, N212, E213, K214, W215, I216, V217, A219, V223, G226, V227, K228, I229, T230, V231, V232, A233, G234, E235, H236, N237, I238, E239, E240, V250, I251, I253, I254, P255, H256, H257, N258, Y259, N260, A261, A262, I263, N264, K265, Y266, N267, H268, D269, I270, A271, L272, L273, E274, L275, D276, E277, P278, L279, V280, L281, S283, Y284, V285, T286, I288, C289, I290, A291, D292, K293, Y295, T296, N297, I298, F299, L300, K301, F302, G303, S304, G305, Y306, V307, S308, W310, G311, V313, F314, H315, K316, G317, R318, S319, A320, L321, V322, L323, Q324, Y325, L326, R327, V328, L330, V331, D332, R333, A334, T335, C336, L337, R338, S339, K341, F342, T343, I344, Y345, N346, N347, M348, F349, C350, A351, G352, F353, H354, E355, G356, G357, R358, D359, S360, C361, V370, V373, E374, G375, S377, F378, L379, T380, G381, I382, I383, S384, W385, E387, E388, A390, M391, K392, G393, Y395, Y398, K400, V401, S402, R403, Y404, V405, N406, W407, I408, K409, E410, K411, K413, of a mature FIX polypeptide set forth in SEQ ID NO: 2 or 1035. Exemplary amino acid modifications that can contribute to reduced immunogenicity of a FIX polypeptide include any one or more amino acid modifications corresponding to any one or more modifications set forth in Table 8 corresponding to amino acid positions of a mature FIX polypeptide set forth in SEQ ID NO: 2 or 1035.

TABLE 8

List of human FIX Modifications for Decreased Immunogenicity

| Y1A | Y1C | Y1D | Y1E | Y1G | Y1H | Y1K | Y1N | Y1P | Y1Q | Y1R | Y1S |
|---|---|---|---|---|---|---|---|---|---|---|---|
| Y1T | S3T | L6A | L6C | L6D | L6E | L6G | L6H | L6K | L6N | L6P | L6Q |
| L6R | L6S | L6T | L6M | F9A | F9C | F9D | F9E | F9G | F9H | F9K | F9N |
| F9P | F9Q | F9R | F9S | F9T | F9I | F9M | F9W | V10A | V10C | V10D | V10E |
| V10G | V10H | V10K | V10N | V10P | V10Q | V10R | V10S | V10T | V10F | V10I | V10M |
| V10W | V10Y | Q11A | Q11C | Q11G | Q11P | G12D | G12E | G12G | G12H | G12K | G12N |
| G12P | G12Q | G12R | G12S | G12T | N13A | N13C | N13G | N13H | N13P | N13T | L14A |
| L14C | L14D | L14E | L14G | L14H | L14K | L14N | L14P | L14Q | L14R | L14S | L14T |
| L14F | L14I | L14M | L14V | L14W | L14Y | E15D | E15H | E15P | R16A | R16C | R16G |
| R16P | R16T | E17A | E17C | E17G | E17P | E17T | C18D | C18E | C18G | C18H | C18K |
| C18N | C18P | C18Q | C18R | C18S | C18T | M19A | M19C | M19D | M19E | M19G | M19H |
| M19K | M19N | M19P | M19Q | M19R | M19S | M19T | M19F | M19I | M19M | M19V | M19W |
| M19Y | E20A | E20C | E20G | E20P | E20T | E21A | E21C | E21G | E21P | K22H | K22P |
| K22T | S24H | S24P | F25A | F25C | F25D | F25E | F25G | F25H | F25K | F25N | F25P |
| F25Q | F25R | F25S | F25T | F25I | F25M | F25W | F25Y | E26A | E26C | E26G | E26P |
| E27A | E27C | E27P | E27G | E27H | E27P | E27S | A28C | A28D | A28E | A28G | A28H |
| A28K | A28N | A28P | A28Q | A28R | A28S | A28T | R29A | R29C | R29G | R29P | E30D |
| E30H | E30P | V31A | V31C | V31D | V31E | V31G | V31H | V31K | V31N | V31P | V31Q |
| V31R | V31S | V31T | V31F | V31I | V31W | V31Y | F32A | F32C | F32D | F32E | F32G |
| F32H | F32K | F32N | F32P | F32Q | F32S | F32T | E33H | E33N | E33P | E33Q |
| E33S | E33T | T35A | T35C | T35G | T35P | F41A | F41C | F41D | F41E | F41G | F41H |
| F41K | F41N | F41P | F41Q | F41R | F41S | F41T | F41M | F41W | F41Y | W42A | W42C |
| W42D | W42E | W42G | W42H | W42K | W42N | W42P | W42Q | W42R | W42S | W42T | K43A |
| K43C | K43G | K43P | Q44P | Q44T | Q44 | Y45A | Y45C | Y45D | Y45E | Y45G | Y45H |
| Y45K | Y45N | Y45P | Y45Q | Y45R | Y45S | Y45T | V46A | V46C | V46D | V46E | V46G |
| V46H | V46K | V46N | V46P | V46Q | V46R | V46S | V46T | V46F | V46I | V46M | V46W |
| V46Y | D47A | D47C | D47G | D47H | D47P | D47T | G48D | G48E | G48P | G48T | D49H |
| D49P | D49Q | D49T | Q50A | Q50D | Q50G | Q50H | Q50P | Q50T | C51D | C51E |
| C51G | C51H | C51K | C51N | C51P | C51Q | C51R | C51S | C51T | E52P | E52T | S53A |
| S53C | S53G | S53H | S53P | S53T | N54H | N54P | N54T | L57A | L57C | L57D | L57E |
| L57G | L57H | L57K | L57N | L57P | L57Q | L57R | L57S | L57T | L57F | L57I | L57M |
| L57W | L57Y | G60C | G60N | G60H | G60T | C62H | C62P | C62H | K63T | D65H |
| D65T | I66A | I66C | I66D | I66E | I66G | I66H | I66K | I66N | I66P | I66Q | I66R |
| I66S | I66T | I66M | I66W | I66Y | Y69A | Y69C | Y69D | Y69E | Y69G | Y69H | Y69K |
| Y69N | Y69P | Y69Q | Y69R | Y69S | Y69T | C71H | C71P | W72A | W72C | W72D | W72E |
| W72G | W72H | W72K | W72N | W72P | W72Q | W72R | W72S | W72T | W72I | W72Y | F75A |
| F75C | F75D | F75G | F75H | F75K | F75N | F75P | F75Q | F75R | F75S | F75T |
| F77A | F77C | F77D | F77E | F77G | F77H | F77K | F77N | F77P | F77Q | F77R | F77S |
| F77T | L84A | L84C | L84D | L84E | L84G | L84H | L84K | L84N | L84P | L84Q | L84R |
| L84S | L84T | L84M | L84W | L84Y | V86A | V86C | V86D | V86E | V86G | V86H | V86K |
| V86N | V86P | V86Q | V86R | V86S | V86T | I90A | I90C | I90D | I90E | I90G | I90H |
| I90K | I90N | I90P | I90Q | I90R | I90S | I90T | I90M | I90W | K91A | K91C | K91G |
| K91P | N92A | N92C | N92G | N92P | N92T | G93D | G93E | G93H | G93K | G93N | G93P |
| G93Q | G93R | G93S | G93T | R94A | R94C | R94G | R94P | C95D | C95E | C95G | C95H |
| C95K | C95N | C95P | C95R | C95S | C95T | E96P | E96T | Q97A | Q97C | Q97G |
| Q97P | F98A | F98C | F98D | F98E | F98G | F98H | F98K | F98N | F98P | F98Q | F98R |
| F98S | F98T | F98M | F98W | F98Y | K100A | K100C | K100G | K100P | N101H | N101T | A103D |
| A103E | A103H | A103K | A103N | A103P | A103Q | A103R | A103S | A103T | D104T | K106H | K106P |
| K106T | V107A | V107C | V107D | V107E | V107G | V107H | V107K | V107N | V107P | V107Q | V107R |
| V107S | V107T | V108A | V108C | V108D | V108E | V108H | V108K | V108N | V108P | V108Q |
| V108R | V108S | V108T | V108F | V108M | V108W | V108Y | S110A | S110C | S110G | S110P | C111D |
| C111E | C111H | C111K | C111N | C111P | C111Q | C111R | C111S | C111T | T112A | T112C | T112G |
| T112P | E113D | E113H | E113P | G114D | G114E | G114H | G114K | G114N | G114P | G114Q | G114R |
| G114S | G114T | Y115A | Y115C | Y115D | Y115E | Y115G | Y115H | Y115K | Y115N | Y115P | Y115Q |

TABLE 8-continued

List of human FIX Modifications for Decreased Immunogenicity

| | | | | | | | | | | | |
|---|---|---|---|---|---|---|---|---|---|---|---|
| Y115R | Y115S | Y115T | Y115M | Y115W | R116P | R116T | L117A | L117C | L117D | L117E | L117G |
| L117H | L117K | L117N | L117P | L117Q | L117R | L117S | L117T | A118D | A118E | A118H | A118K |
| A118N | A118P | A118Q | A118R | A118S | A118T | N120D | N120H | N120P | Q121T | S123H | S123T |
| V128A | V128C | V128D | V128E | V128G | V128H | V128K | V128N | V128P | V128Q | V128R | V128S |
| V128T | F130A | F130C | F130D | F130E | F130G | F130H | F130K | F130N | F130P | F130Q | F130R |
| F130S | F130T | V135A | V135C | V135D | V135E | V135G | V135H | V135K | V135N | V135P | V135Q |
| V135R | V135S | V135T | V135W | V135Y | V137A | V137C | V137D | V137E | V137G | V137H | V137K |
| V137N | V137P | V137Q | V137R | V137S | V137T | V137M | V137W | V137Y | S138H | S138T | T140D |
| T140H | S141T | K142H | K142P | L143A | L143C | L143D | L143E | L143G | L143H | L143K | L143N |
| L143P | L143Q | L143R | L143S | L143T | L143F | L143I | L143M | L143V | L143W | L143Y | R145H |
| R145P | R145T | A146P | A146T | T148H | T148P | V149A | V149C | V149D | V149E | V149G | V149H |
| V149K | V149N | V149P | V149Q | V149R | V149S | V149T | V149F | V149I | V149M | V149W | V149Y |
| F150A | F150C | F150D | F150E | F150G | F150H | F150K | F150N | F150P | F150Q | F150R | F150S |
| F150T | F150M | F150W | F150Y | D152A | D152C | D152G | D152P | D152S | D152T | V153A | V153C |
| V153D | V153E | V153G | V153H | V153K | V153N | V153P | V153Q | V153R | V153S | V153T | V153F |
| V153I | V153M | V153W | V153Y | D154A | D154C | D154G | D154P | D154Q | D154S | Y155A | Y155C |
| Y155D | Y155E | Y155G | Y155H | Y155K | Y155N | Y155P | Y155Q | Y155R | Y155S | Y155T | Y155M |
| Y155V | Y155W | V156A | V156C | V156D | V156E | V156G | V156H | V156K | V156N | V156P | V156Q |
| V156R | V156S | V156T | V156I | V156M | V156W | V156Y | N157A | N157C | N157G | N157H | N157P |
| N157Q | N157T | S158H | S158P | S158T | T159A | T159C | T159G | T159P | E160A | E160C | E160G |
| E160P | A161C | A161D | A161E | A161H | A161K | A161N | A161P | A161Q | A161R | A161S | A161T |
| E162P | E162T | T163A | T163C | T163G | T163P | I164A | I164C | I164D | I164E | I164G | I164H |
| I164K | I164N | I164P | I164Q | I164R | I164S | I164T | L165A | L165C | L165D | L165E | L165G |
| L165H | L165K | L165N | L165P | L165Q | L165R | L165S | L165T | L165M | L165W | L165Y | I168A |
| I168C | I168D | I168E | I168G | I168H | I168K | I168N | I168P | I168Q | I168R | I168S | I168T |
| F175A | F175C | F175D | F175E | F175G | F175H | F175K | F175N | F175P | F175Q | F175R | F175S |
| F175T | F178A | F178C | F178D | F178E | F178G | F178H | F178K | F178N | F178P | F178Q | F178R |
| F178S | F178T | F178M | F178W | F178Y | T179A | T179C | T179G | T179P | R180A | R180C | R180D |
| R180G | R180H | R180P | V181A | V181C | V181D | V181E | V181G | V181H | 181K | V181N | V181P |
| V181Q | V181R | V181S | V181T | V181F | V181I | V181M | V181W | V181Y | V182A | V182C | V182D |
| V182E | V182G | V182H | V182K | V182N | V182P | V182Q | V182R | V182S | V182T | V182F | V182I |
| V182M | V182W | V182Y | G183D | G183E | G183H | G183K | G183N | G183P | G183Q | G183S | G183T |
| G184D | G184E | G184H | G184K | G184N | G184P | G184Q | G184R | G184S | G184T | E185A | E185C |
| E185G | E185H | E185P | E185T | D186A | D186C | D186G | D186H | D186P | D186T | A187C | A187D |
| A187E | A187G | A187H | A187K | A187N | A187P | A187Q | A187R | A187S | A187T | K188A | K188C |
| K188G | K188H | K188P | K188T | G190D | G190E | G190H | G190K | G190N | G190P | G190Q | G190R |
| G190S | G190T | F192A | F192C | F192D | F192E | F192G | F192H | F192K | F192N | F192P | F192Q |
| F192R | F192S | F192T | F192W | F192Y | W194A | W194C | W194D | W194E | W194G | W194H | W194K |
| W194N | W194P | W194Q | W194R | W194S | W194T | Q195H | Q195P | Q195T | V196A | V196C | V196D |
| V196E | V196G | V196H | V196K | V196N | V196P | V196Q | V196R | V196S | V196T | V196F | V196I |
| V196M | V196W | V196Y | V197A | V197C | V197D | V197E | V197G | V197H | V197K | V197N | V197P |
| V197Q | V197R | V197S | V197T | V197F | V197I | V197M | V197W | V197Y | L198A | L198C | L198D |
| L198E | L198G | L198H | L198K | L198N | L198P | L198Q | L198R | L198S | L198T | L198I | L198Y |
| N199A | N199C | N199G | N199H | N199P | N199S | N199T | G200P | G200T | K201A | K201C | K201D |
| K201E | K201G | K201H | K201N | K201P | K201Q | K201S | K201T | V202A | V202C | V202D | V202E |
| V202G | V202H | V202K | V202N | V202P | V202Q | V202R | V202S | V202T | V202F | V202I | V202M |
| V202W | V202Y | D203A | D203C | D203G | D203P | D203T | A204C | A204D | A204E | A204G | A204H |
| A204K | A204N | A204P | A204Q | A204R | A204S | A204T | F205A | F205C | F205D | F205E | F205G |
| F205H | F205K | F205N | F205P | F205Q | F205R | F205S | F205T | F205M | F205V | F205W | F205Y |
| G207H | G207P | G208C | G208D | G208E | G208H | G208K | G208N | G208P | G208Q | G208R | G208S |
| G208T | S209A | S209C | S209G | S209P | I210A | I210C | I210D | I210E | I210G | I210H | I210K |
| I210N | I210P | I210Q | I210R | I210S | I210T | I210F | I210W | I210Y | V211A | V211C | V211D |
| V211E | V211G | V211H | V211K | V211N | V211P | V211Q | V211R | V211S | V211T | V211F | V211I |
| V211M | V211W | N212A | N212C | N212G | N212P | E213H | E213P | E213S | E213T | K214T | W215A |
| W215C | W215D | W215E | W215G | W215H | W215K | W215N | W215P | W215Q | W215R | W215S | W215T |
| I216A | I216C | I216D | I216E | I216G | I216H | I216K | I216N | I216P | I216Q | I216R | I216S |
| I216T | V217A | V217C | V217D | V217E | V217G | V217H | V217K | V217N | V217P | V217Q | V217R |
| V217S | V217T | V217I | V217Y | A219H | A219P | A219T | V223A | V223C | V223D | V223E | V223G |
| V223H | V223K | V223N | V223P | V223Q | V223R | V223S | V223T | V223M | V223W | V223Y | G226P |
| V227A | V227C | V227D | V227E | V227G | V227H | V227K | V227N | V227P | V227Q | V227R | V227S |
| V227T | V227F | V227I | V227M | V227W | V227Y | K228A | K228C | K228G | K228H | K228P | I229A |
| I229C | I229D | I229E | I229G | I229H | I229K | I229N | I229P | I229Q | I229R | I229S | I229T |
| I229M | I229W | I229Y | T230A | T230C | T230G | T230P | V231A | V231C | V231D | V231E | V231G |
| V231H | V231K | V231N | V231P | V231Q | V231R | V231S | V231T | V232A | V232C | V232D | V232E |
| V232G | V232H | V232K | V232N | V232P | V232Q | V232R | V232S | V232T | V232F | V232I | V232M |
| V232W | V232Y | A233C | A233D | A233E | A233G | A233H | A233K | A233N | A233P | A233Q | A233R |
| A233S | A233T | A233V | G234D | G234E | G234H | G234K | G234N | G234P | G234Q | G234R | G234S |
| G234T | E235H | E235N | E235P | E235Q | E235S | E235T | H236A | H236C | H236G | H236P | N237A |
| N237C | N237G | N237P | N237T | I238A | I238C | I238D | I238E | I238G | I238H | I238K | I238N |
| I238P | I238Q | I238R | I238S | I238T | E239A | E239C | E239G | E239P | E240H | E240T | V250A |
| V250C | V250D | V250E | V250G | V250H | V250K | V250N | V250P | V250Q | V250R | V250S | V250T |
| V250M | V250W | V250Y | I251A | I251C | I251D | I251E | I251G | I251H | I251K | I251N | I251P |
| I251Q | I251R | I251S | I251T | I253A | I253C | I253D | I253E | I253G | I253H | I253K | I253N |
| I253P | I253Q | I253R | I253S | I253T | I253M | I253W | I253Y | I254A | I254C | I254D | I254E |
| I254G | I254H | I254K | I254N | I254P | I254Q | I254R | I254S | I254T | P255H | H256P | H256T |
| H257A | H257C | H257G | H257P | N258P | N258T | Y259A | Y259C | Y259D | Y259E | Y259G | Y259H |
| Y259K | Y259N | Y259P | Y259Q | Y259R | Y259S | Y259T | Y259M | Y259W | N260A | N260C | 260G |
| N260P | A261D | A261E | A261H | A261K | A261N | A261P | A261Q | A261R | A261S | A261T | A262C |

TABLE 8-continued

List of human FIX Modifications for Decreased Immunogenicity

| | | | | | | | | | | | |
|---|---|---|---|---|---|---|---|---|---|---|---|
| A262D | A262E | A262G | A262H | A262K | A262N | A262P | A262Q | A262R | A262S | A262T | I263A |
| I263C | I263D | I263E | I263G | I263H | I263K | I263N | I263P | I263Q | I263R | I263S | I263T |
| I263M | I263V | I263W | I263Y | N264A | N264C | N264D | N264G | N264H | N264P | K265A | K265C |
| K265G | K265H | K265P | Y266A | Y266C | Y266D | Y266E | Y266G | Y266H | Y266K | Y266N | Y266P |
| Y266Q | Y266R | Y266S | Y266T | Y266M | Y266W | N267A | N267C | N267G | N267H | N267P | N267T |
| H268P | D269A | D269C | D269E | D269G | D269H | D269N | D269P | D269Q | D269S | D269T | I270A |
| I270C | I270D | I270E | I270G | I270H | I270K | I270N | I270P | I270Q | I270R | I270S | I270T |
| I270M | I270W | A271C | A271D | A271E | A271G | A271H | A271K | A271N | A271P | A271Q | A271R |
| A271S | A271T | L272A | L272C | L272D | L272E | L272G | L272H | L272K | L272N | L272P | L272Q |
| L272R | L272S | L272T | L272F | L273A | L273C | L273D | L273E | L273G | L273H | L273K | L273N |
| L273P | L273Q | L273R | L273S | L273T | L273F | L273I | L273M | L273V | L273W | L273Y | E274A |
| E274C | E274G | E274P | E274T | L275A | L275C | L275D | L275E | L275G | L275H | L275K | L275N |
| L275P | L275Q | L275R | L275S | L275T | L275W | L275Y | D276P | D276S | D276T | E277A | E277C |
| E277G | E277P | P278T | L279A | L279C | L279D | L279E | L279G | L279H | L279K | L279N | L279P |
| L279Q | L279R | L279S | L279T | L279I | L279Y | V280A | V280C | V280D | V280E | V280G | V280H |
| V280K | V280N | V280P | V280Q | V280R | V280S | V280T | V280F | V280I | V280W | V280Y | L281A |
| L281C | L281D | L281E | L281G | L281H | L281K | L281N | L281P | L281Q | L281R | L281S | L281T |
| L281F | L281I | L281V | L281W | L281Y | S283A | S283C | S283G | S283P | Y284A | Y284C | Y284D |
| Y284E | Y284G | Y284H | Y284K | Y284N | Y284P | Y284Q | Y284R | Y284S | Y284T | Y284M | V285A |
| V285C | V285D | V285E | V285G | V285H | V285K | V285N | V285P | V285Q | V285R | V285S | V285T |
| V285M | V285W | V285Y | T286A | T286C | T286G | T286P | I288A | I288C | I288D | I288E | I288G |
| I288H | I288K | I288N | I288P | I288Q | I288R | I288S | I288T | C289D | C289H | C289P | I290A |
| I290C | I290D | I290E | I290G | I290H | I290K | I290N | I290P | I290Q | I290R | I290S | I290T |
| I290Y | A291D | A291E | A291H | A291K | A291N | A291P | A291Q | A291R | A291S | A291T | D292A |
| D292C | D292G | D292P | D292T | K293H | K293P | K293T | Y295A | Y295C | Y295D | Y295E | Y295G |
| Y295H | Y295K | Y295N | Y295P | Y295Q | Y295R | Y295S | Y295T | Y295W | T296A | T296C | T296G |
| T296P | N297A | N297C | N297G | N297P | I298A | I298C | I298D | I298E | I298G | I298H | I298K |
| I298N | I298P | I298Q | I298R | I298S | I298T | F299A | F299C | F299D | F299E | F299G | F299H |
| F299K | F299N | F299P | F299Q | F299R | F299S | F299T | L300A | L300C | L300D | L300E | L300G |
| L300H | L300K | L300N | L300P | L300Q | L300R | L300S | L300T | L300F | L300I | L300M | L300V |
| L300W | L300Y | K301A | K301C | K301G | K301P | K301T | F302A | F302C | F302D | F302E | F302G |
| F302H | F302K | F302N | F302P | F302Q | F302R | F302S | F302T | G303H | G303P | G303T | S304A |
| S304C | S304G | S304P | S304T | G305D | G305E | G305H | G305N | G305P | G305Q | G305S | G305T |
| Y306A | Y306C | Y306D | Y306E | Y306G | Y306H | Y306K | Y306N | Y306P | Y306Q | Y306R | Y306S |
| Y306T | V307A | V307C | V307D | V307E | V307G | V307H | V307K | V307N | V307P | V307Q | V307R |
| V307S | V307T | S308P | S308T | W310A | W310C | W310D | W310E | W310G | W310H | W310K | W310N |
| W310P | W310Q | W310R | W310S | W310T | G311H | V313A | V313C | V313D | V313E | V313G | V313H |
| V313K | V313N | V313P | V313Q | V313R | V313S | V313T | F314A | F314C | F314D | F314E | F314G |
| F314H | F314K | F314N | F314P | F314Q | F314R | F314S | F314T | F314M | F314W | F314Y | H315A |
| H315C | H315G | H315P | K316A | K316C | K316G | K316P | G317C | G317D | G317E | G317H | G317K |
| G317N | G317P | G317Q | G317R | G317S | G317T | R318A | R318C | R318G | R318P | S319D | S319H |
| S319N | S319P | S319Q | A320C | A320D | A320E | A320G | A320H | A320K | A320N | A320P | A320Q |
| A320R | A320S | A320T | L321A | L321C | L321D | L321E | L321G | L321H | L321K | L321N | L321P |
| L321Q | L321R | L321S | L321T | V322A | V322C | V322D | V322E | V322G | V322H | V322K | V322N |
| V322P | V322Q | V322R | V322S | V322T | V322W | V322Y | L323A | L323C | L323D | L323E | L323G |
| L323H | L323K | L323N | L323P | L323Q | L323R | L323S | L323T | L323F | L323I | L323M | L323V |
| L323W | L323Y | Q324A | Q324C | Q324G | Q324P | Y325A | Y325C | Y325D | Y325E | Y325G | Y325H |
| Y325K | Y325N | Y325P | Y325Q | Y325R | Y325S | Y325T | Y325W | L326A | L326C | L326D | L326E |
| L326G | L326H | L326K | L326N | L326P | L326Q | L326R | L326S | L326T | L326F | L326I | L326M |
| L326V | L326W | L326Y | R327A | R327C | R327G | R327H | R327P | V328A | V328C | V328D | V328E |
| V328G | V328H | V328K | V328N | V328P | V328Q | V328R | V328S | V328T | V328F | V328I | V328M |
| V328W | V328Y | L330A | L330C | L330D | L330E | L330G | L330H | L330K | L330N | L330P | L330Q |
| L330R | L330S | L330T | L330F | L330I | L330V | L330W | L330Y | V331A | V331C | V331D | V331E |
| V331G | V331H | V331K | V331N | V331P | V331Q | V331R | V331S | V331T | V331F | V331I | V331M |
| V331W | V331Y | D332A | D332C | D332G | D332P | R333A | R333C | R333D | R333E | R333G | R333H |
| R333N | R333P | R333Q | R333R | R333S | R333T | A334C | A334D | A334E | A334G | A334H | A334K |
| A334N | A334P | A334Q | A334R | A334S | A334T | T335A | T335C | T335G | T335P | C336D | C336E |
| C336H | C336K | C336N | C336P | C336Q | C336R | C336S | C336T | L337A | L337C | L337D | L337E |
| L337G | L337H | L337K | L337N | L337P | L337Q | L337R | L337S | L337T | R338A | R338C | R338G |
| R338P | S339P | S339T | K341A | K341C | K341G | K341P | F342A | F342C | F342D | F342E | F342G |
| F342H | F342K | F342N | F342P | F342Q | F342R | F342S | F342T | F342M | F342W | T343A | T343C |
| T343G | T343P | I344A | I344C | I344D | I344E | I344G | I344H | I344K | I344N | I344P | I344Q |
| I344R | I344S | I344T | Y345A | Y345C | Y345D | Y345E | Y345G | Y345H | Y345K | Y345N | Y345P |
| Y345Q | Y345R | Y345S | Y345T | Y345M | Y345W | N346A | N346C | N346G | N346P | N347H | N347P |
| M348A | M348C | M348D | M348E | M348G | M348H | M348K | M348N | M348P | M348Q | M348R | M348S |
| M348T | F349A | F349C | F349D | F349E | F349G | F349H | F349K | F349N | F349P | F349Q | F349R |
| F349S | F349T | F349I | F349M | F349W | F349Y | C350D | C350H | C350P | C350T | A351E | A351H |
| A351N | A351P | A351Q | A351R | A351S | A351T | G352A | G352C | G352P | F353A | F353C | F353D |
| F353E | F353G | F353H | F353K | F353N | F353P | F353Q | F353R | F353S | F353T | F353I | F353M |
| F353W | H354A | H354C | H354G | H354P | E355A | E355C | E355D | E355G | E355H | E355K | E355N |
| E355P | E355Q | E355S | E355T | G356D | G356E | G356H | G356K | G356N | G356P | G356Q | G356R |
| G356S | G356T | G357D | G357E | G357H | G357K | G357N | G357P | G357Q | G357R | G357S | G357T |
| R358D | R358E | R358H | R358K | R358N | R358P | R358Q | R358R | R358S | R358T | D359A | D359C |
| D359G | D359P | D359Q | D359S | D359T | S360A | S360C | S360G | S360P | C361D | C361E | C361H |
| C361K | C361N | C361P | C361Q | C361R | C361S | C361T | V370A | V370C | V370D | V370E | V370G |
| V370H | V370K | V370N | V370P | V370Q | V370R | V370S | V370T | V370W | V370Y | V373A | V373C |
| V373D | V373E | V373G | V373H | V373K | V373N | V373P | V373Q | V373R | V373S | V373T | V373F |
| V373I | V373M | V373W | E374A | E374C | E374G | E374P | G375H | S377A | S377C | S377G | S377P |

TABLE 8-continued

| List of human FIX Modifications for Decreased Immunogenicity | | | | | | | | | | | |
|---|---|---|---|---|---|---|---|---|---|---|---|
| F378A | F378C | F378D | F378E | F378G | F378H | F378K | F378N | F378P | F378Q | F378R | F378S |
| F378T | F378W | L379A | L379C | L379D | L379E | L379G | L379H | L379K | L379N | L379P | L379Q |
| L379R | L379S | L379T | L379I | L379M | L379W | L379Y | T380A | T380C | T380G | T380P | G381D |
| G381E | G381H | G381K | G381N | G381P | G381Q | G381R | G381S | G381T | I382A | I382C | I382D |
| I382E | I382G | I382H | I382K | I382N | I382P | I382Q | I382R | I382S | I382T | I382M | I382W |
| I382Y | I383A | I383C | I383D | I383E | I383G | I383H | I383K | I383N | I383P | I383Q | I383R |
| I383S | I383T | S384A | S384C | S384G | S384P | W385A | W385C | W385D | W385E | W385G | W385H |
| W385K | W385N | W385P | W385Q | W385R | W385S | W385T | W385M | E387A | E387C | E387G | E387H |
| E387P | E387T | E388H | E388N | E388P | E388Q | E388T | A390C | A390D | A390E | A390G | A390H |
| A390K | A390N | A390P | A390Q | A390R | A390S | M391A | M391C | M391D | M391E | M391G | M391H |
| M391K | M391N | M391P | M391Q | M391R | M391S | M391T | M391F | M391I | M391W | M391Y | K392A |
| K392C | K392G | K392P | G393C | G393D | G393E | G393H | G393K | G393N | G393P | G393Q | G393R |
| G393S | G393T | Y395A | Y395C | Y395D | Y395E | Y395G | Y395H | Y395K | Y395N | Y395P | Y395Q |
| Y395R | Y395S | Y395T | Y398A | Y398C | Y398D | Y398E | Y398G | Y398H | Y398K | Y398N | Y398P |
| Y398Q | Y398R | Y398S | Y398T | K400H | V401A | V401C | V401D | V401E | V401G | V401H | V401K |
| V401N | V401P | V401Q | V401R | V401S | V401T | V401F | V401I | V401M | V401W | V401Y | S402A |
| S402C | S402G | S402P | R403A | R403C | R403G | R403P | R403T | Y404A | Y404C | Y404D | Y404E |
| Y404G | Y404H | Y404K | Y404N | Y404P | Y404Q | Y404R | Y404S | Y404T | V405A | V405C | V405D |
| V405E | V405G | V405H | V405K | V405N | V405P | V405Q | V405R | V405S | V405T | V405W | V405Y |
| N406F | N406H | N406I | N406L | N406P | N406W | N406Y | W407D | W407E | W407F | W407H | W407I |
| W407K | W407N | W407P | W407Q | W407R | W407S | W407T | W407Y | I408D | I408E | I408H | I408K |
| I408N | I408P | I408Q | I408R | I408S | I408T | K409F | K409H | K409I | K409P | K409T | K409V |
| K409W | K409Y | E410H | K411A | K411C | K411G | K411I | K411P | K411T | K411V | K411W | K411Y |
| K413T | | | | | | | | | | | | b. Glycosylation

Many proteins with therapeutic activity contain one or more glycosylation sites, such as, amino acid sequences that are glycosylated by a eukaryotic cell. There have been various reports of attempts to increase the degree of glycosylation of therapeutic proteins in order to achieve 1) reduced immunogenicity; 2) less frequent administration of the protein; 3) increased protein stability such as increased serum half-life; and 4) reduction in adverse side effects such as inflammation. The glycosylation site(s) provides a site for attachment of a carbohydrate moiety on the subject polypeptide; such that when the subject polypeptide is produced in a eukaryotic cell capable of glycosylation, the subject polypeptide is glycosylated. The further glycosylation of a FIX polypeptide confers one or more advantages including increased serum half-life; reduced immunogenicity; increased functional in vivo half-life; reduced degradation by gastrointestinal tract conditions such as gastrointestinal tract proteases; and increased rate of absorption by gut epithelial cells. An increased rate of absorption by gut epithelial cells and reduced degradation by gastrointestinal tract conditions is important for enteral (such as oral) formulations of a FIX polypeptide.

Glycosylation of proteins results in the formation of glycoproteins due to the covalent attachment of oligosaccharides to a polypeptide. The carbohydrate modifications found in glycoproteins are linked to the protein component through either O-glycosidic or N-glycosidic bonds. The predominant carbohydrate attachment in glycoproteins of mammalian cells is via N-glycosidic linkage. The N-glycosidic linkage is through the amide group of asparagines. The site of carbohydrate attachment to N-linked glycoproteins is found within a consensus sequence of amino acids, N—X—S/T, where X is any amino acid except proline. In N-linked glycosylation, the carbohydrate directly attached to the protein is GlcNAc. Since glycosylation is known to be highly host cell-dependent, the sugar chains associated with N-linked glycosylation of a protein can differ (Kagawa et al., (1988) *Journal of Biological Chemistry* 263:17508-17515). The O-glycosidic linkage is to the hydroxyl of serine, threonine or hydroxylysine. In Ser- and Thr-type O-linked glycoproteins, the carbohydrate directly attached to the protein is GalNAc. A number of O-linked glycosylation sites are known in the art and have been reported in the literature, see such as Ten Hagen et al. (1999) *Journal of Biological Chemistry,* 274:27867-74; Hanisch et al. (2001) *Glycobiology,* 11:731-740; and Ten Hagen et al., (2003) *Glycobiology,* 13:1R-16R.

Modified FIX polypeptides provided herein can further be glycosylated (i.e. hyperglycosylated) as compared to an unmodified FIX polypeptide due to 1) a carbohydrate moiety covalently linked to at least one non-native glycosylation site not found in the unmodified FIX polypeptide or 2) a carbohydrate moiety covalently linked to at least one native glycosylation site found but not glycosylated in the unmodified FIX polypeptide. A hyperglycosylated FIX polypeptide can include O-linked glycosylation, N-linked glycosylation, and/or a combination thereof. In some examples, a hyperglycosylated FIX polypeptide can include 1, 2, 3, 4 or 5 carbohydrate moieties, each linked to different glycosylation sites. The glycosylation site can be a native glycosylation site. In other examples, the hyperglycosylated polypeptide can be glycosylated at a single non-native glycosylation site. In still other examples, the hyperglycosylated polypeptide can be glycosylated at more than one non-native glycosylation site, such as, the hyperglycosylated FIX polypeptide can be glycosylated at 2, 3 or 4 non-native glycosylation sites.

In some instances, a hyperglycosylated FIX polypeptide is glycosylated at a native glycosylation site. For example, FIX, such as for example human FIX having an amino acid sequence set forth in SEQ ID NO: 2, contains N-linked glycosylation sites at N157 and N167 and O-linked glycosylation sites at S53, S61, T159, T169, T172, and T179. The FIX polypeptide can be glycosylated at a single native glycosylation site, or at more than one native glycosylation site, such as, at 2, 3 or 4 native glycosylation sites. A hyperglycosylated FIX polypeptide also can be glycosylated at a native glycosylation site and a non-native glycosylation site. A hyperglycosylated FIX polypeptide also can be glycosylated at multiple native and non-native glycosylation sites.

Modified FIX polypeptides provided herein can have at least one additional carbohydrate moiety not found in the unmodified FIX polypeptide when each is synthesized in a eukaryotic cell that is capable of N- and/or O-linked protein glycosylation. Thus, e.g., compared to an unmodified FIX polypeptide, a hyperglycosylated modified FIX polypeptide can have at least 1, at least 2, at least 3, at least 4, at least 5, at least 6, at least 7, at least 8, at least 9, at least 10, or more additional carbohydrate moieties. For example, where an unmodified FIX polypeptide has one covalently linked carbohydrate moiety, a hyperglycosylated FIX polypeptide can have 2, 3, 4, 5, 6, 7, 8, 9, 10, or more covalently linked carbohydrate moieties. In some examples, a hyperglycosylated FIX polypeptide of a modified FIX polypeptide provided herein, lacks a carbohydrate moiety covalently linked to a non-native glycosylation site, and has instead at least 1, at least 2, at least 3, at least 4, at least 5, at least 6, at least 7, at least 8, at least 9, at least 10, or more additional carbohydrate moieties attached to native glycosylation sites. In other examples, a hyperglycosylated FIX polypeptide lacks a carbohydrate moiety covalently linked to a native glycosylation site, and has instead at least 2, at least 3, at least 4, at least 5, at least 6, at least 7, at least 8, at least 9, at least 10, or more carbohydrate moieties attached to non-native glycosylation sites. In some examples, the compositions of the attached sugars can be modified, such as by increasing or decreasing sialic acid content of the attach sugar moieties.

Whether a subject FIX polypeptide has N-linked and/or O-linked glycosylation is readily determined using standard techniques, see such as, "Techniques in Glycobiology" R. Townsend and A. Hotchkiss, eds. (1997) Marcel Dekker; and "Glycoanalysis Protocols (Methods in Molecular Biology, Vol. 76)" E. Hounsell, ed. (1998) Humana Press. The change in electrophoretic mobility of a protein before and after treatment with chemical or enzymatic deglycosylation (such as, using endoglycosidases and/or exoglycosidases) is routinely used to determine the glycosylation status of a protein. Enzymatic deglycosylation can be carried out using any of a variety of enzymes, including, but not limited to, peptide-N4-(N-acetyl-β-D-glycosaminyl) asparagine amidase (PNGase F); endoglycosidase F1, endoglycosidase F2 and endoglycosidase F3, α(2→3,6,8,9) neuraminidase. For example, sodium dodecyl sulfate-polyacrylamide gel electrophoresis (SDS-PAGE) analysis of the protein, either pre-treated with PNGaseF or untreated with PNGaseF, is conducted. A marked decrease in band width and change in migration position after treatment with PNGaseF is considered diagnostic of N-linked glycosylation. The carbohydrate content of a glycosylated protein also can be detected using lectin analysis of protein blots (such as, proteins separated by SDS-PAGE and transferred to a support, such as a nylon membrane). Lectins, carbohydrate binding proteins from various plant tissues, have high affinity and narrow specificity for a wide range of defined sugar epitopes found on glycoprotein glycans (Cummings (1994) *Methods in Enzymol.* 230:66-86). Lectins can be detectably labeled (either directly or indirectly), allowing detection of binding of lectins to carbohydrates on glycosylated proteins. For example, when conjugated with biotin or digoxigenin, a lectin bound to a glycosylated protein can be easily identified on membrane blots through a reaction utilizing avidin or anti-digoxigenin antibodies conjugated with an enzyme such as alkaline phosphatase, β-galactosidase, luciferase or horse radish peroxidase, to yield a detectable product. Screening with a panel of lectins with well-defined specificity provides considerable information about a glycoprotein's carbohydrate complement.

Exemplary amino acid positions contemplated herein for modification of a glycosylation site, for attachment of a carbohydrate moiety, include positions corresponding to positions N157 or N167 of a mature FIX polypeptide set forth in SEQ ID NO: 2. Amino acid replacement or replacements can correspond to any of the following positions: N157 or N167 of mature FIX. In a particular embodiment, the amino acid replacement or replacements contributing to hyperglycosylation of modified FIX polypeptides is (are) replacement of amino acids by asparagines (N) or threonine (T). Thus, provided herein are modified FIX polypeptides containing a further modification corresponding to any one or more of N157 or N167 of a mature FIX polypeptide set forth in SEQ ID NO: 2.

c. Additional Modifications

Additional modifications of polypeptides provided herein include chemical derivatization of polypeptides, including but not limited to, acetylation and carboxylation; changes in amino acid sequence that make the protein susceptible to PEGylation or other modification or that alter properties of the FIX polypeptide. Related moieties for modifying FIX polypeptides also are contemplated, including, but not limited to copolymers of polyethylene glycol and polypropylene glycol, carboxymethylcellulose, dextran, polyvinyl alcohol, polyvinylpyrrolidine or polyproline (Abuchowski et al. (1981); Newmark et al. (1982); and Katre et al. (1987)). A modified FIX polypeptide provided herein can be modified with one or more polyethylene glycol moieties (PEGylated). Activated PEG derivatives can be used to interact directly with the FIX polypeptides, and include active esters of carboxylic acid or carbonate derivatives, particularly those in which the leaving groups are N-hydroxysuccinimide, p-nitrophenol, imidazole or 1-hydroxy-2-nitrobenzene-4-sulfonate. PEG derivatives containing maleimido or haloacetyl groups can be used for the modification of sulfhydryl groups, and PEG reagents containing hydrazine or hydrazide groups can be used to modify aldehydes generated by periodate oxidation of carbohydrate groups. In some instances, a modified FIX polypeptide provided herein can contain one or more non-naturally occurring pegylation sites that are engineered to provide PEG-derivatized polypeptides with reduced serum clearance (U.S. Published Patent Application No: 2006-0040856).

Also contemplated are modified FIX polypeptides sequences that have phosphorylated amino acid residues, such as phosphotyrosine, phosphoserine or phosphothreonine.

Other suitable additional modifications of a modified FIX polypeptide provided herein are polypeptides that have been modified using standard chemical techniques and/or recombinant nucleic acid method as to increase their resistance to proteolytic degradation, to optimize solubility properties and/or to render them more suitable as a therapeutic agent. For example, the backbone of the peptide can be cyclized to enhance stability (see such as, Friedler et al. (2000) *J. Biol. Chem.* 275:23783-23789). Analogs can be used that include residues other than naturally occurring L-amino acids, such as, D-amino acids or non-naturally occurring synthetic amino acids.

Modifications of FIX polypeptides provided herein also can be combined with modifications to improve post-translational processing of the FIX polypeptides. For example, FIX polypeptides can be modified to improve proteolytic cleavage of the signal or propeptides sequences (U.S. Pat. Application No. 2004-0102388), and/or to improve post-translational modifications such as carboxylation, phosphorylation, sulfation, and/or glycosylation, as discussed above. An exemplary modification that improves propeptide cleavage includes, modification of Y1, in particular Y1A (Meulien et al. (1990) *Protein. Eng.* 3(7): 629-633 and U.S. Pat. Nos. 4,770,999 and 5,521,070).

Modifications of FIX polypeptides provided herein also can be combined with amino acid modifications to further improve stability, binding properties and serum half-life of the FIX polypeptides. A non-limiting example of such modification includes replacement of all or part of the FIX activation peptide (amino acid residues A 146 through R180 of a mature FIX polypeptide, SEQ ID NO: 2) with an activation peptide of another vitamin K-dependent polypeptide, such as FVII, FX, or protein C. Another non-limiting example of such modification includes replacement of all or part of the gla domain (amino acid residues Y1 through V46 of a mature FIX polypeptide, SEQ ID NO: 2) with a gla domain of another vitamin K-dependent polypeptide, such as FVII, FX, or protein C. Such modifications and generation of chimeric proteins are described in, for example, published International PCT application No. WO 2006/018204 A1, Lin et al. (1990) *J. Biol. Chem.* 265(1):144-150 and Cheung et al. (1991) *J. Biol. Chem.* 266(14):8797-880. In another example, amino acid residues in FIX polypeptides that are involved in binding to collagen, in particular collagen IV in the liver, can be modified to increase circulating levels of the FIX polypeptides in the blood. For example, K5 and V10 in the γ-carboxyglutamic acid (gla) domain can be modified, such as K5A and/or V10K (Cheung et al. (1992) *J. Biol. Chem.* 267(29): 20529-20531, Gui et al. (2002) *Blood* 100(1): 153-158, and Schuettrumpf et al. (2005) *Blood* 105(6): 2316-2323). In yet another example modified FIX polypeptide can contain modifications to increase resistance to inhibition by heparin. One such modification is described in, for example, U.S. Pat. Application No. 2004-0110675.

Additional modifications that alter properties or activities of FIX polypeptides, such as, peptidase activity, coagulant activity, esterase activity, protein binding activities (such as to FVIII, FX, or FXI), cofactor binding activities, such as Ca2+, phospholipid or cell surface binding activities, and increased resistance to inhibitors, such as heparin and warfarin, are known in the art and can be combined with the modifications provided herein. Exemplary modifications of the peptidase activity include replacement of amino acid residues of the catalytic domain, H221, D269, S365 (U.S. Pat. No. 6,315, 995) or replacement of R338 to enhance clotting activity (U.S. Pat. No. 6,531,298 and Chang et al. (1998) *J. Biol. Chem.* 273(20): 12089-12094). Peptidase activity also can be altered by modifying substrate binding sites or cofactor sites. For example, modifications of K316 can alter binding of factor X to modified FIX polypeptides (Kolkman and Mertens (2000) *Biochem. J.* 350: 701-707). Exemplary modifications of FIX polypeptides with altered $Ca^{2+}$ binding include replacement of residues in the EGF-like domains, such as, but not limited to, G60S, or replacement of the EGF-1 domain of FIC with that of FVII (Chang et al. (1995) *Thromb and Haemost. Abst* 73:1202). Exemplary modifications of FIX polypeptides that alter FVIIIa-dependent FIXa activity include mutations in the α-helical regions 333-339 and 301-333, which interact with FVIIIa. One or more properties of a FIX polypeptide may be altered as a result of a modification or combination of modifications. For example, modification of $Ca^{2+}$ binding may lead to a change in coagulation activity.

F. PRODUCTION OF FIX POLYPEPTIDES

1. Expression Systems

FIX polypeptides (modified and unmodified) can be produced by any methods known in the art for protein production, including the introduction of nucleic acid molecules encoding FIX into a host cell, host animal and expression from nucleic acid molecules encoding FIX in vitro. Expression hosts include *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Expression in eukaryotic hosts can include expression in yeasts such as *Saccharomyces cerevisiae* and *Pichia Pastoria*, insect cells such as *Drosophila* cells and lepidopteran cells, plants and plant cells such as tobacco, corn, rice, algae and lemna. Eukaryotic cells for expression also include mammalian cells lines such as Chinese hamster ovary (CHO) cells. Eukaryotic expression hosts also include production in transgenic animals, for example, including production in serum, milk and eggs. Transgenic animals for the production of wild-type FIX polypeptides are known in the art (U.S. Patent Publication Nos. 2002-0166130 and 2004-0133930) and can be adapted for production of modified FIX polypeptides provided herein.

Many expression vectors are available for the expression of FIX. The choice of expression vector is influenced by the choice of host expression system. Such selection is well within the level of skill of the skilled artisan. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vectors in the cells.

Methods of production of FIX polypeptides can include coexpression of one or more additional heterologous polypeptides that can aid in the generation of the FIX polypeptides. For example, such polypeptides can contribute to the post-translation processing of the FIX polypeptides. Exemplary polypeptides include, but are not limited to, peptidases that help cleave FIX precursor sequences, such as the propeptide sequence, and enzymes that participate in the modification of the FIX polypeptide, such as by glycosylation, hydroxylation, carboxylation or phosphorylation, for example. An exemplary peptidase that can be coexpressed with FIX is PACE/furin (or PACE-SOL), which aids in the cleavage of the FIX propeptide sequence (Harrison et al. (1998) *Semin Hematol.* 35(2 Suppl 2): 4-10). An exemplary protein that aids in the carboxylation of the FIX polypeptide is the warfarin-sensitive enzyme vitamin K 2,3-epoxide reductase (VKOR), which produces reduced vitamin K for utilization as a cofactor by the vitamin K-dependent γ-carboxylase (Wajih et al., *J. Biol. Chem.* 280(36)31603-31607). A subunit of this enzyme, VKORC1, can be coexpressed with the modified FIX polypeptide to increase the γ-carboxylation The one or more additional polypeptides can be expressed from the same expression vector as the FIX polypeptide or from a different vector.

a. Prokaryotic Expression

Prokaryotes, especially *E. coli*, provide a system for producing large amounts of FIX (see, for example, Platis et al. (2003) *Protein Exp. Purif.* 31(2): 222-30; and Khalizzadeh et al. (2004) *J. Ind. Microbiol. Biotechnol.* 31(2): 63-69). Transformation of *E. coli* is a simple and rapid technique well known to those of skill in the art. Expression vectors for *E. coli* can contain inducible promoters that are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated $\lambda P_L$ promoter.

FIX can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants (such as, such as guanidine-HCl and urea) can be used to resolubilize the proteins. An alternative approach is the expression of FIX in the periplasmic space of bacteria which provides an oxidizing environment and chaperonin-like and disulfide isomerases leading to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility. Typically, temperatures between 25° C. and 37° C. are used. Mutations also can be used to increase solubility of expressed proteins. Typically, bacteria produce aglycosylated proteins. Thus, if proteins require glycosylation for function, glycosylation can be added in vitro after purification from host cells.

b. Yeast

Yeasts such as *Saccharomyces cerevisiae, Schizosaccharomyces pombe, Yarrowia lipolytica, Kluyveromyces lactis*, and *Pichia pastoris* are useful expression hosts for FIX (see for example, Skoko et al. (2003) *Biotechnol. Appl. Biochem.* 38(Pt3):257-65). Yeast can be transformed with episomal replicating vectors or by stable chromosomal integration by homologous recombination. Typically, inducible promoters are used to regulate gene expression. Examples of such promoters include GAL1, GAL7, and GAL5 and metallothionein promoters such as CUP1. Expression vectors often include a selectable marker such as LEU2, TRP1, HIS3, and URA3 for selection and maintenance of the transformed DNA. Proteins expressed in yeast are often soluble and co-expression with chaperonins, such as Bip and protein disulfide isomerase, can improve expression levels and solubility. Additionally, proteins expressed in yeast can be directed for secretion using secretion signal peptide fusions such as the yeast mating type alpha-factor secretion signal from *Saccharomyces cerevisiae* and fusions with yeast cell surface proteins such as the Aga2p mating adhesion receptor or the *Arxula adeninivorans* glucoamylase. A protease cleavage site (such as, the Kex-2 protease) can be engineered to remove the fused sequences from the polypeptides as they exit the secretion pathway. Yeast also is capable of glycosylation at Asn-X-Ser/Thr motifs.

c. Insects and Insect Cells

Insects and insect cells, particularly using a baculovirus expression system, are useful for expressing polypeptide such as FIX (see, for example, Muneta et al. (2003) *J. Vet. Med. Sci.* 65(2):219-23). Insect cells and insect larvae, including expression in the haemolymph, express high levels of protein and are capable of most of the post-translational modifications used by higher eukaryotes. Baculoviruses have a restrictive host range which improves the safety and reduces regulatory concerns of eukaryotic expression. Typically, expression vectors use a promoter such as the polyhedrin promoter of baculovirus for high level expression. Commonly used baculovirus systems include baculoviruses such as *Autographa californica* nuclear polyhedrosis virus (AcNPV), and the *bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express FIX polypeptides. Expression constructs can be, transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high level expression, for example the SV40 promoter-enhancer, the human cytomegalovirus (CMV) promoter, and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha-fetoprotein, alpha 1-antitrypsin, beta-globin, myelin basic protein, myosin light chain-2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, chicken and hamster cells. Exemplary cell lines include, but are not limited to, CHO, Balb/3T3, HeLa, MT2, mouse NS0 (non-secreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. One such example is the serum free EBNA-1 cell line (Pham et al., (2003) *Biotechnol. Bioeng.* 84:332-42). Expression of recombinant wild-type FIX polypeptides exhibiting similar structure and post-translational modifications as plasma-derived FIX are known in the art (see, such as, Bon et al. (1998) *Semin Hematol.* 35 (2 Suppl 2): 11-17). Methods of optimizing Factor IX expression are known. For example, supplementation of vitamin K in culture medium or co-expression of vitamin K-dependent γ-carboxylases (Wajih et al., *J. Biol. Chem.* 280(36)31603-31607) can aid in post-translational modification of FIX polypeptides. Multiple purification steps also can aid in enriched subpopulations of FIX polypeptides with desired post-translational modifications including, γ-carboxylation, β-hydroxylation, and glycosylation.

e. Plants

Transgenic plant cells and plants can be used for the expression of FIX. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements, and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteins (see, for example, Mayfield et al. (2003) *PNAS* 100:438-442). Because plants have different glycosylation patterns than mammalian cells, this can influence the choice to produce FIX in these hosts.

2. Purification

Methods for purification of FIX polypeptides from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary the proteins can be extracted and further purified using standard methods in the art.

FIX can be purified using standard protein purification techniques known in the art including but not limited to, SDS-PAGE, size fraction and size exclusion chromatography, ammonium sulfate precipitation, chelate chromatography and ionic exchange chromatography. Multiple chromatographic steps can be employed to improve selection of FIX polypeptides with particular posttranslational modifications. For example, multiple chromatographic steps can be used to separate γ-carboxylated FIX polypeptides (see such as, Cott et al. (2004) *Papers in Biotechnology* 1-21). Such techniques also can be used to enrich for FIX polypeptides with or without modifications at particular sites, including modifications such as, but not limited to, γ-carboxylation of particular glutamic acid residues in the gla domain, phosphorylation (e.g., at S158), sulfation (such as, at Y155), and glycosylation (see such as, Kaufman et al. (1986) *J Biol Chem* 261: 9622-8; Harrison et al. (1998) *Semin Hematol* 35 (Suppl. 2): 4-10; Bond et al. (1998) *Semin Hematol* 35 (Suppl. 2): 11-7).

Affinity purification techniques also can be used to improve the efficiency and purity of the preparations. For example, antibodies, receptors and other molecules that bind FIX can be used in affinity purification. Expression constructs also can be engineered to add an affinity tag such as a myc epitope, GST fusion or $His_6$ and affinity purified with myc antibody, glutathione resin, and Ni-resin, respectively, to a protein. Purity can be assessed by any method known in the art including gel electrophoresis and staining and spectrophotometric techniques.

3. Fusion Proteins

Fusion proteins containing a targeting agent and a modified FIX polypeptide also are provided. Pharmaceutical compositions containing such fusion proteins formulated for administration by a suitable route are provided. Fusion proteins are formed by linking in any order the modified FIX polypeptide and an agent, such as an antibody or fragment thereof, growth factor, receptor, ligand, and other such agent for directing the mutant protein to a targeted cell or tissue. Linkage can be effected directly or indirectly via a linker. The fusion proteins can be produced recombinantly or chemically by chemical linkage, such as via heterobifunctional agents or thiol linkages or other such linkages. The fusion proteins can contain additional components, such as *E. coli* maltose binding protein (MBP) that aid in uptake of the protein by cells (see, International PCT application No. WO 01/32711). In another embodiment the modified FIX is fused to polypeptides that aid in stability, such as albumin (Sheffield et al. (2004) *Br. J. Haemotol.* 126(4): 565-573).

4. Polypeptide Modification

Modified FIX polypeptides can be prepared as naked polypeptide chains or as a complex. For some applications, it can be desirable to prepare modified FIX in a "naked" form without post-translational or other chemical modifications. Naked polypeptide chains can be prepared in suitable hosts that do not post-translationally modify FIX. Such polypeptides also can be prepared in in vitro systems and using chemical polypeptide synthesis. For other applications, particular modifications can be desired including pegylation, albumination, glycosylation, carboxylation, hydroxylation, phosphorylation, or other known modifications. Modifications can be made in vitro or, for example, by producing the modified FIX in a suitable host that produces such modifications.

5. Nucleotide Sequences

Nucleic acid molecules encoding modified FIX polypeptides or the fusion protein operationally linked to a promoter, such as an inducible promoter for expression in mammalian cells also are provided. Such promoters include, but are not limited to, CMV and SV40 promoters; adenovirus promoters, such as the E2 gene promoter, which is responsive to the HPV E7 oncoprotein; a PV promoter, such as the PBV p89 promoter that is responsive to the PV E2 protein; and other promoters that are activated by the HIV or PV or oncogenes.

Modified FIX polypeptides provided herein also can be delivered to cells in gene transfer vectors. The transfer vectors can encode additional therapeutic agent(s) for treatment of diseases or disorders, such as treatments for hemophilia, inherited disorders and others for which FIX is administered. Transfer vectors encoding modified FIX polypeptides can be used systemically by administering the nucleic acid to a subject. For example, the transfer vector can be a viral vector, such as an adenoviral vector. Vectors encoding FIX also can be incorporated into stem cells and such stem cells administered to a subject, for example, by transplanting or engrafting the stem cells at sites for therapy. For example, mesenchymal stem cells (MSCs) can be engineered to express a modified FIX and such MSCs engrafted at a tumor site for therapy.

G. ASSESSING MODIFIED FIX POLYPEPTIDE PROPERTIES AND ACTIVITIES

FIX activities and properties can be assessed in vitro and/or in vivo. Assays for such assessment are known to those of skill in the art and are known to correlate tested activities and results to therapeutic and in vivo activities. In one example, FIX variants can be assessed in comparison to unmodified and/or wild-type FIX. In other examples, a modified FIX polypeptide can be assessed for biological activity following in vitro or in vivo exposure to protein stability-altering conditions (i.e. exposure to proteases, or denaturing agents such as temperature or pH). In vitro assays include any laboratory assay known to one of skill in the art, such as for example, cell-based assays including coagulation assays, protein assays, and molecular biology assays. In vivo assays include FIX assays in animal models as well as administration to humans. In some cases, activity of FIX in vivo can be determined by assessing blood, serum, or other bodily fluid for assay determinants. FIX variants also can be tested in vivo to assess an activity or property, such as stability (such as, half-life) and therapeutic effect.

1. In Vitro Assays

Exemplary in vitro assays include assays to assess polypeptide stability and activity. Stability assays include assays that assess protease resistance or thermal stability or other physical property indicative of stability of the polypeptide in vivo or in vitro. Stability also can be assessed by protein structure and conformational assays known in the art. Assays for activity include, but are not limited to, measurement of FIX interaction with other coagulation cofactors, such as factor VIII, enzymatic assays to determine proteolytic activity of FIX polypeptides, and cell-based assays to determine the effect of FIX polypeptides variants on coagulation.

Concentrations of modified FIX polypeptides can be assessed by methods well-known in the art, including but not limited to enzyme-linked immunosorbant assays (ELISA), SDS-PAGE; Bradford, Lowry, BCA methods; UV absorbance, and other quantifiable protein labeling methods, such as, but not limited to, immunological, radioactive and fluorescent methods and related methods.

Assessment of cleavage products of proteolysis reactions, including cleavage of FIX polypeptides or products produced by FIX protease activity, can be performed using methods including but not limited to, chromogenic substrate cleavage, HPLC, SDS-PAGE analysis, immunohistochemistry, immunoprecipitation, $NH_2$-terminal sequencing, and protein labeling.

FIX polypeptides that have been activated via proteolytic cleavage after R145 and R180 can be prepared in vitro. The FIX polypeptides can be first prepared by any of the methods of production described herein, including, but not limited to, production in mammalian cells followed by purification. Cleavage of the FIX polypeptides into the active protease form of FIX can be accomplished by incubation with activated factor XI (FXIa). The activated polypeptides can be used in any of the assays to measure FIX activities described herein.

Modified FIX polypeptides can be tested for proteolytic activity. Activated forms of the modified FIX polypeptides (FIXa) can be used in the assay. Assays using a synthetic substrate, such as a $CH_3SO_2$-LGR-pNA peptide, can be employed to measure enzymatic cleavage activity of the FIXa polypeptides. Hydrolysis of $CH_3SO_2$-LGR-pNA in the presence of FIXa can be measured by assessing the production of p-nitroanaline (pNA) from the cleavage reaction sample. The amount of pNA in the sample is proportional to the absorbance of the sample at 405 nm and thus indicates the extent of proteolytic activity in the FIXa sample. Additional exemplary fluorogenic substrates that can be used to assess FIXa cleavage activity include, but are not limited to, Mes-D-CHD-Gly-Arg-AMC (Pefafluor FIXa10148) and H-D-Leu-PHG-Arg-AMC (Pefafluor FIXa3688), wherein cleavage is assessed by release of AMC. Molecules that enhance FIXa catalytic activity, such as ethylene glycol, can be employed in such assays (Sturzebecher et al. (1997) *FEBS Lett*. (412) 295-300).

Proteolytic activity of FIXa also can be assessed by measuring the conversion of factor X (FX) into activated factor X (FXa). Modified FIXa polypeptides can be incubated in the presence of FX polypeptides in the presence of phospholipids vesicles (phosphatidylserine and/or phosphatidylcholine) and $Ca^{2+}$, and cleavage of FX to produce FXa can be assayed using a chromogenic substrate, such as S2222 or S2765, which is specifically cleaved by FXa (Chromogenics A B, Molndal, Sweden).

Inhibition assays can be used to measure resistance of modified FIX polypeptides to FIX inhibitors. Exemplary inhibitors include, but are not limited to, antithrombin, p-aminobenzamidine, serine protease inhibitors, and FIX-specific antibodies. Inhibitors such as antithrombin which bind to the active site of FIXa can be used in inhibition assays, such as competition assays, wherein the ability of the inhibitor to compete with another substrate is measured.

FIX polypeptides can be tested for binding to other coagulation factors and inhibitors. For example, FIX direct and indirect interactions with proteins of the tenase complex, including factors VIIIa, IXa and X, and inhibitors, such as antithrombin III and heparin can be assessed using any binding assay known in the art, including, but not limited to, immunoprecipitation, column purification, non-reducing SDS-PAGE, surface plasmon resonance (SPR), fluorescence resonance energy transfer (FRET), fluorescence polarization (FP), isothermal titration calorimetry (ITC), circular dichroism (CD), protein fragment complementation assays (PCA), Nuclear Magnetic Resonance (NMR) spectroscopy, light scattering, sedimentation equilibrium, small-zone gel filtration chromatography, gel retardation, Far-western blotting, fluorescence polarization, hydroxyl-radical protein footprinting, phage display, and various two-hybrid systems.

FIX polypeptides can be tested for coagulation activity by using assays well known in the art. For example, some of the assays include, but are not limited to, a two stage clotting assay, (Leibman, H. A. et al. (1985) *Proc. Natl. Acad. Sci., USA*, 82, 3879-3883); an assay based on the single stage activated partial thromboplastin time ("aPTT"), Smith, K. J. et al. (1988) *Blood,* 72, 1269-1277; and assays which are modifications of the aPTT test, for example, Jenny, R. et al. (1986) *Preparative Biochemistry,* 16, 227-245, whole blood partial thromboplastin time (PTT), activated clotting time (ACT), recalcified activated clotting time, or the Lee-White Clotting time. For the aPTT assay, coagulation activity of a FIX polypeptide can be assessed by using equal volumes of activated partial thromboplastin reagent, FIX-deficient plasma (obtained from either a patient with hemophilia B using sterile phlebotomy techniques well known in the art or by using FIX immunodepleted plasma), and normal pooled plasma as standard, or the sample. In this assay, one unit of activity is defined as that amount present in one milliliter of normal pooled plasma. Further, an assay for biological activity based on the ability of FIX to reduce the clotting time of plasma from FIX-deficient patients to normal can be performed as described in, for example, Proctor and Rapaport (1961) *Amer. J. Clin. Path.* 36: 212.

FIX polypeptides also can be assessed for presence of post-translational modifications. Such assays are known in the art and include assays to measure glycosylation, hydroxylation, sulfation, carboxylation, and phosphorylation. In an exemplary assay for glycosylation, carbohydrate analysis can be performed, for example, with SDS page analysis of FIX polypeptides exposed to hydrazinolysis or endoglycosidase treatment. Hydrazinolysis releases N- and O-linked glycans from glycoproteins by incubation with anhydrous hydrazine, while endoglycosidase release involves PNGase F, which releases most N-glycans from glycoproteins. Hydrazinolysis or endoglycosidase treatment of FIX polypeptides generates a reducing terminus that can be tagged with a fluorophore or chromophore label. Labeled FIX polypeptides can be analyzed by fluorophore-assisted carbohydrate electrophoresis (FACE). The fluorescent tag for glycans also can be used for monosaccharide analysis, profiling or fingerprinting of complex glycosylation patterns by HPLC. Exemplary HPLC methods include hydrophilic interaction chromatography, electronic interaction, ion-exchange, hydrophobic interaction, and size-exclusion chromatography. Exemplary glycan probes include, but are not limited to, 3-(acetylamino)-6-aminoacridine (AA-Ac) and 2-aminobenzoic acid (2-AA). Carbohydrate moieties also can be detected through use of specific antibodies that recognize the glycosylated FIX polypeptide.

An exemplary assay to measure carboxylation comprises reverse phase HPLC analysis of FIX polypeptides that have been subjected to alkaline hydrolysis (Przysiecki et al. (1987) *PNAS* 84: 7856-7860). Exemplary assays to measure phosphorylation include use of phosphospecific antibodies to phospho-serine and/or -tyrosine amino acid residues or to a serine-phosphorylated FIX polypeptide. $^{32}$P metabolic labeling of cells that produce the FIX polypeptide also can be used to assess phosphorylation, wherein the labeled FIX polypeptide can be purified and analyzed for incorporation of radioactive phosphate. An exemplary assay for tyrosine sulfation includes $^{35}$S labeling of cells that produce the FIX polypeptide. In such method, cells are incubated with either $^{35}$S—$S_2SO_4$ or $^{35}$S-methionine and incorporation of the $^{35}$S is determined by normalization to the $^{35}$S-methionine sample.

Structural properties of modified FIX polypeptides also can be assessed. For example, X-ray crystallography, nuclear magnetic resonance (NMR), and cryoelectron microscopy (cryo-EM) of modified FIX polypeptides can be performed to assess three-dimensional structure of the FIX polypeptides and/or other properties of FIX polypeptides, such as $Ca^{2+}$ or cofactor binding.

Additionally, the presence and extent of FIX degradation can be measured by standard techniques such as sodium dodecyl sulfate polyacrylamide gel electrophoresis (SDS-PAGE), and Western blotting of electrophoresed FIX-containing samples. FIX polypeptides that have been exposed to proteases also can be subjected to N-terminal sequencing to determine location or changes in cleavage sites if the modified FIX polypeptides.

2. Non-Human Animal Models

Non-human animal models can be used to assess activity and stability of modified FIX polypeptides. For example, non-human animals can be used as models for a disease or condition. Non-human animals can be injected with disease and/or phenotype-inducing substances prior to administration of FIX variants to monitor the effects on disease progression. Genetic models also are useful. Animals, such as mice, can be generated which mimic a disease or condition by the overexpression, underexpression or knock-out of one or more genes. Such animals can be generated by transgenic animal production techniques well-known in the art or using naturally-occurring or induced mutant strains. Examples of useful non-human animal models of diseases associated with FIX include, but are not limited to, models of bleeding disorders, in particular hemophilia, or thrombotic disease. These non-human animal models can be used to monitor activity of FIX variants compared to a wild type FIX polypeptide.

Animal models also can be used to monitor stability, half-life, and clearance of modified FIX polypeptides. Such assays are useful for comparing modified FIX polypeptides and for calculating doses and dose regimens for further non-human animal and human trials. For example, a modified FIX polypeptide can be injected into the tail vein of mice. Blood samples are then taken at time-points after injection (such as minutes, hours and days afterwards) and then the level of the modified FIX polypeptides in bodily samples including, but not limited to, serum or plasma can be monitored at specific time-points for example by ELISA or radioimmunoassay. Blood samples also can be tested for coagulation activity in methods, such as the aPTT assay.

Modified FIX polypeptides can be tested for immune tolerance using animal models. Animal models for immune tolerance of FIX are known in the art and include rhesus macaque, mouse, rat, and dog models to test long term expression of FIX via injection of polypeptides or gene transfer vectors (Lozier et al. (1999) *Blood* 93(6) 1875-1881 and Keith et al. (1995) *Thromb. Haemost.* 73(1): 101-105).

Modified FIX polypeptides can be tested for therapeutic effectiveness using animal models for hemophilia. In one non-limiting example, an animal model such as a mouse can be used. Mouse models of hemophilia are available in the art and include FIX deficient mice and mice expressing mutant FIX polypeptides, and can be employed to test modified FIX polypeptides (Wang et al. (1997) *PNAS* 94:11563-11566, Lin et al. (1997) *Blood* 90:3962-3966, Kundu et al. (1998) *Blood* 92: 168-174, Sabatino et al. (2004) *Blood* 104(9): 2767-2774 and Jin et al. (2004) *Blood* 104:1733-1739)

Other models of FIX deficiencies include hemophilic dogs that express defective FIX or that have been hepatectomized (Evans et al. (1989) *PNAS* 86:10095, Mauser et al. (1996) *Blood* 88:345I, and Kay et al. (1994) *PNAS* 91:2353-2357).

Modified FIX polypeptides can be tested for therapeutic effectiveness using animal models for thrombotic disease (Dodds (1987) *Ann N Y Acad Sci.* 516: 631-635). Modified FIX polypeptides that have antithrombotic activity can be tested in such models. In one non-limiting example, an animal model such as a rat or mouse model of ischemic stroke can be used to test the effectiveness of modified FIX polypeptides. Such animal models are known in the art (Beech, et al. (2001) *Brain Res* 895: 18-24, Buchan et al. *Stroke* 23: 273-9 (1992), Carmichael et al. (2005) *NeuroRx* 2: 396-409, Chen et al. (1986) *Stroke* 17: 738-43, Gerriets et al. (2003) *J Neurosci Methods* 122: 201-11, Koizumi et al. (1986) *Jpn. J. Stroke* 8: 1-8, Longa et al. (1989) *Stroke* 20: 84-91, Mayzel-Oreg et al. (2004) *Magn Reson Med* 51: 1232-8, Tamura, et al. (1981) *J Cereb Blood Flow Metab* 1: 53-60, Watson et al. (1985) *Ann Neurol* 17: 497-504, Zhang et al. (1997) *J Cereb Blood Flow Metab* 17: 123-35).

3. Clinical Assays

Many assays are available to assess activity of FIX for clinical use. Such assays can include assessment of coagulation, protein stability, and half-life in vivo and phenotypic assays. Phenotypic assays and assays to assess the therapeutic effect of FIX treatment include assessment of blood levels of FIX (such as measurement of serum FIX prior to administration and time-points following administrations including, after the first administration, immediately after last administration, and time-points in between, correcting for the body mass index (BMI)), phenotypic response to FIX treatment including amelioration of symptoms over time compared to subjects treated with an unmodified and/or wild type FIX or placebo. Examples of clinical assays to assess FIX activity can be found such as in Franchini et al. (2005) *Thromb Haemost.* 93(6): 1027-1035, Shapiro et al. (2005) *Blood* 105(2): 518-525, and White et al. (1997) *Thromb Haemost.* 78(1): 261-265. Patients can be monitored regularly over a period of time for routine or repeated administrations, following administration in response to acute events, such as hemorrhage, trauma, or surgical procedures.

H. FORMULATION/PACKAGING/ADMINISTRATION

Pharmaceutical compositions containing an optimized polypeptide produced using methods described herein, including FIX variant (modified) polypeptides, modified FIX fusion proteins or encoding nucleic acid molecules, can be formulated in any conventional manner by mixing a selected amount of the polypeptide with one or more physiologically acceptable carriers or excipients. Selection of the carrier or excipient is within the skill of the administering profession and can depend upon a number of parameters. These include, for example, the mode of administration (i.e., systemic, oral, nasal, pulmonary, local, topical or any other mode) and disorder treated. The pharmaceutical compositions provided herein can be formulated for single dosage (direct) administration or for dilution or other modification. The concentrations of the compounds in the formulations are effective for delivery of an amount, upon administration, that is effective for the intended treatment. Typically, the compositions are formulated for single dosage administration. To formulate a composition, the weight fraction of a compound or mixture thereof is dissolved, suspended, dispersed or otherwise mixed in a selected vehicle at an effective concentration such that the treated condition is relieved or ameliorated. Pharmaceutical carriers or vehicles suitable for administration of the compounds provided herein include any such carriers known to those skilled in the art to be suitable for the particular mode of administration.

1. Administration of Modified FIX Polypeptides

The polypeptides can be formulated as the sole pharmaceutically active ingredient in the composition or can be combined with other active ingredients. The polypeptides can be targeted for delivery, such as by conjugation to a targeting agent, such as an antibody. Liposomal suspensions, including tissue-targeted liposomes, also can be suitable as pharmaceutically acceptable carriers. These can be prepared according to methods known to those skilled in the art. For example, liposome formulations can be prepared as described in U.S. Pat. No. 4,522,811. Liposomal delivery also can include slow release formulations, including pharmaceutical matrices such as collagen gels and liposomes modified with fibronectin (see, for example, Weiner et al. (1985) *J Pharm Sci.* 74(9): 922-5).

The active compound is included in the pharmaceutically acceptable carrier in an amount sufficient to exert a therapeutically useful effect in the absence of undesirable side effects on the subject treated. The therapeutically effective concentration can be determined empirically by testing the compounds in known in vitro and in vivo systems, such as the assays provided herein. The active compounds can be administered by any appropriate route, for example, oral, nasal, pulmonary, parenteral, intravenous, intradermal, subcutaneous, or topical, in liquid, semi-liquid or solid form and are formulated in a manner suitable for each route of administration. In a particular embodiment, the FIX polypeptide is administered orally. FIX polypeptides can be formulated with additional coagulation factors.

The modified FIX and physiologically acceptable salts and solvates can be formulated for administration by inhalation (either through the mouth or the nose), oral, transdermal, pulmonary, parenteral, or rectal administration or injection. For administration by inhalation, the modified FIX can be delivered in the form of an aerosol spray presentation from pressurized packs or a nebulizer with the use of a suitable propellant, such as, dichlorodifluoromethane, trichlorofluoromethane, dichlorotetrafluoroethane, carbon dioxide or other suitable gas. In the case of a pressurized aerosol, the dosage unit can be determined by providing a valve to deliver a metered amount. Capsules and cartridges of such as, gelatin for use in an inhaler or insufflator can be formulated containing a powder mix of a therapeutic compound and a suitable powder base such as lactose or starch.

FIX polypeptides can be formulated as liquid or powder. In the case of a liquid, the modified polypeptides can be injected from a syringe or an auto-injector. In the case of a powder, the modified polypeptides can be reconstituted with a pharmaceutically acceptable excipient, such as pharmaceutically-acceptable saline, prior to administration. Administration can be by a medical professional or self-administration.

For pulmonary administration to the lungs, the modified FIX can be delivered in the form of an aerosol spray presentation from a nebulizer, turbonebulizer, or microprocessor-controlled metered dose oral inhaler with the use of a suitable propellant. Generally, the particle size is small, such as in the range of 0.5 to 5 microns. In the case of a pharmaceutical composition formulated for pulmonary administration, detergent surfactants are not typically used. Pulmonary drug delivery is a promising non-invasive method of systemic administration. The lungs represent an attractive route for drug delivery, mainly due to the high surface area for absorption, thin alveolar epithelium, extensive vascularization, lack of hepatic first-pass metabolism, and relatively low metabolic activity.

The modified FIX polypeptides exhibit increased resistance to proteolysis and half-life in the gastrointestinal tract. Thus, preparations for oral administration can be suitably formulated without the use of protease inhibitors, such as a Bowman-Birk inhibitor, a conjugated Bowman-Birk inhibitor, aprotinin and camostat.

The modified FIX polypeptides can be formulated as a depot preparation. Such long-acting formulations can be administered by implantation (for example, subcutaneously or intramuscularly) or by intramuscular injection. Thus, for example, the therapeutic compounds can be formulated with suitable polymeric or hydrophobic materials (for example as an emulsion in an acceptable oil) or ion exchange resins, or as sparingly soluble derivatives, for example, as a sparingly soluble salt.

The modified FIX can be formulated, for example, for parenteral administration by injection (such as, by bolus injection or continuous infusion). Formulations for injection can be presented in unit dosage form (such as, in ampoules or in multi-dose containers) with an added preservative. The compositions can take such forms as suspensions, solutions or emulsions in oily or aqueous vehicles and can contain formulatory agents such as suspending, stabilizing and/or dispersing agents. Alternatively, the active ingredient can be in powder-lyophilized form for constitution with a suitable vehicle, such as, sterile pyrogen-free water, before use.

Preparations for oral administration can be suitably formulated to give controlled release of the active compound. For buccal administration the compositions can take the form of tablets or lozenges formulated in a conventional manner.

The pharmaceutical compositions can be formulated for local or topical application, such as for topical application to the skin (transdermal) and mucous membranes, such as in the eye, in the form of gels, creams, and lotions and for application to the eye or for intracisternal or intraspinal application. Such solutions, particularly those intended for ophthalmic use, can be formulated as 0.01%-10% isotonic solutions and pH about 5-7 with appropriate salts. The compounds can be formulated as aerosols for topical application, such as by inhalation (see, for example, U.S. Pat. Nos. 4,044,126, 4,414,209 and 4,364,923, which describe aerosols for delivery of a steroid useful for treatment inflammatory diseases, particularly asthma).

The concentration of active compound in the drug composition depends on absorption, inactivation and excretion rates of the active compound, the dosage schedule, and amount administered as well as other factors known to those of skill in the art. As described further herein, dosages can be determined empirically using dosages known in the art for administration of unmodified FIX, and comparisons of properties and activities (such as, stability and activities) of the modified FIX compared to the unmodified and/or native FIX.

The compositions, if desired, can be presented in a package, in a kit or dispenser device, that can contain one or more unit dosage forms containing the active ingredient. The package, for example, contains metal or plastic foil, such as a blister pack. The pack or dispenser device can be accompanied by instructions for administration. The compositions containing the active agents can be packaged as articles of manufacture containing packaging material, an agent provided herein, and a label that indicates the disorder for which the agent is provided.

a. Oral Administration

Among the modified FIX polypeptides provided herein are FIX polypeptides modified to increase protein stability to conditions amendable to oral delivery. Oral delivery can include administration to the mouth and/or gastrointestinal tract. Such modifications can include increased protein-half life under one or more conditions such as exposure to saliva, exposure to proteases in the gastrointestinal tract, exposure to increased temperature, and exposure to particular pH conditions, such as the low pH of the stomach and/or pH conditions in the intestine. For example, modifications can include resistance to one or more proteases including pepsin, trypsin, chymotrypsin, elastase, aminopeptidase, gelatinase B, gelatinase A, α-chymotrypsin, carboxypeptidase, endoproteinase Arg-C, endoproteinase Asp-N, endoproteinase Glu-C, endoproteinase Lys-C, luminal pepsin, microvillar endopeptidase, dipeptidyl peptidase, enteropeptidase, hydrolase, NS3, elastase, factor Xa, Granzyme B, thrombin, plasmin, urokinase, tPA and PSA. Modifications also can include increasing overall stability to potentially denaturing or conformation-altering conditions such as thermal tolerance, and tolerance to mixing and aeration (such as, chewing).

FIX polypeptides modified for suitability to oral delivery can be prepared using any of the methods described herein. For example, 2D- and 3D-scanning mutagenesis methods for protein rational evolution (see, co-pending U.S. Publication No. US 2005-0202438 A1 and U.S. Publication No. US-2004-0132977-A1 and published International applications WO 2004/022593 and WO 2004/022747) can be used to prepare modified FIX. Modification of FIX polypeptides for suitability for oral delivery can include removal of proteolytic digestion sites and/or increasing the overall stability of the protein structure. Such FIX variants exhibit increased protein half-life compared to an unmodified and/or wild-type native FIX in one or more conditions for oral delivery. For example, a modified FIX can have increased protein half-life and/or bioavailability in the mouth, throat (such as, through the mucosal lining), the gastrointestinal tract or systemically.

In one embodiment, the half-life of the modified FIX polypeptides provided herein is increased by an amount at least about or 1%, 2%, 3%, 4%, 5%, 6%, 7%, 8%, 9%, 10%, at least 20%, at least 30%, at least 40%, at least 50%, at least 60%, at least 70%, at least 80%, at least 90%, at least 100%, at least 150%, at least 200%, at least 250%, at least 300%, at least 350%, at least 400%, at least 450%, at least 500% or more, when compared to the half-life of a native FIX polypeptide exposed to one or more conditions (i.e. proteases, pH, temperature) for oral delivery. In other embodiments, the half-life in vitro or in vivo (protein stability) of the modified FIX polypeptides provided herein is increased by an amount of at least 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more, compared to the half-life of native FIX exposed to one or more conditions for oral delivery (i.e. proteases, pH, temperature).

In one example, half-life of the modified FIX polypeptide is assessed by increased half-life in the presence of one or more proteases. Proteases include, but are not limited to, proteases in blood, serum, the gastrointestinal tract, and the stomach. For example, proteases include, but are not limited to, pepsin, trypsin, chymotrypsin, elastase, aminopeptidase, gelatinase B, gelatinase A, α-chymotrypsin, carboxypeptidase, endoproteinase Arg-C, endoproteinase Asp-N, endoproteinase Glu-C, endoproteinase Lys-C, trypsin, luminal pepsin, microvillar endopeptidase, dipeptidyl peptidase, enteropeptidase, hydrolase, NS3, elastase, factor Xa, Granzyme B, thrombin, plasmin, urokinase, tPA and PSA. The modified polypeptide can be mixed with one or more proteases and then assessed for activity and/or protein structure after a suitable reaction time. In one embodiment, the modified polypeptide is at least 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100% more resistant to proteolysis.

Assessment of half-life also can include exposure to increased temperature, such as the body temperature of a subject; exposure to gastric juices and/or simulated gastric juices; exposure to particular pH conditions and/or a combination of two or more conditions. Following exposure to one or more conditions, activity and/or assessment of protein structure can be used to assess the half-life of the modified FIX in comparison to an appropriate control (i.e., an unmodified and/or wild-type FIX polypeptide).

For oral administration, the pharmaceutical compositions can take the form of, for example, tablets, pills, liquid suspensions, or capsules prepared by conventional means with pharmaceutically acceptable excipients such as binding agents (such as, pregelatinized maize starch, polyvinylpyrrolidone or hydroxypropyl methylcellulose); fillers (such as, lactose, microcrystalline cellulose or calcium hydrogen phosphate); lubricants (such as, magnesium stearate, talc or silica); disintegrants (such as, potato starch or sodium starch glycolate); or wetting agents (such as, sodium lauryl sulphate). The tablets can be coated by methods well known in the art. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically-acceptable saline, pharmaceutically acceptable additives such as suspending agents (such as, sorbitol syrup, cellulose derivatives or hydrogenated edible fats); emulsifying agents (such as, lecithin or acacia); non-aqueous vehicles (such as, almond oil, oily esters, ethyl alcohol or fractionated vegetable oils); and preservatives (such as, methyl or propyl-p-hydroxybenzoates or sorbic acid). The preparations also can contain buffer salts, flavoring, coloring and sweetening agents as appropriate.

The modified FIX polypeptides can be formulated for oral administration, Oral formulations include tablets, capsules, liquids or other suitable vehicle for oral administration. In some examples, the capsules or tablets are formulated with an enteric coating to be gastro-resistant. Preparation of pharmaceutical compositions containing a modified FIX for oral delivery can include formulating modified FIX polypeptides with oral formulations known in the art and/or those described herein. The compositions as formulated do not require addition of protease inhibitors and/or other ingredients that are necessary for stabilization of unmodified (for protease resistance) and wild-type FIX polypeptides upon exposure to proteases, such as selecting pH and other conditions to minimize protease cleavage. For example, such compositions exhibit stability in the absence of compounds such as actinonin or epiactinonin and derivatives thereof; Bowman-Birk inhibitor and conjugates thereof; aprotinin and camostat. In other examples, the preparations for oral administration can include protease inhibitors.

Additionally, because modified FIX polypeptides provided herein exhibit increased protein stability, there is more flexibility in the administration of pharmaceutical compositions than their unmodified counterparts. Typically, orally ingested polypeptides are administered in the morning before eating (i.e., before digestive enzymes are activated). The modified polypeptides provided herein exhibit protease resistance to digestive enzymes and can offer the ability to administer pharmaceutical compositions containing a modified FIX polypeptide at other periods during the day and under conditions when digestive enzymes are present and active.

For oral administration, the pharmaceutical compositions can take the form of, for example, tablets or capsules prepared by conventional means with pharmaceutically acceptable excipients such as binding agents (such as, pre-gelatinized maize starch, polyvinylpyrrolidone or hydroxypropyl methylcellulose); fillers (such as, lactose, microcrystalline cellulose or calcium hydrogen phosphate); lubricants (such as, magnesium stearate, talc or silica); disintegrants (such as, potato starch or sodium starch glycolate); or wetting agents (such as, sodium lauryl sulphate). The active ingredient present in the capsule can be in, for example, liquid or lyophilized form. The tablets or capsules can be coated by methods well known in the art. Tablets and capsules can be coated, for example, with an enteric coating. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically acceptable additives such as suspending agents (such as, sorbitol syrup, cellulose derivatives or hydrogenated edible fats); emulsifying agents (such as, lecithin or acacia); non aqueous vehicles (such as, almond oil, oily esters, ethyl alcohol or fractionated vegetable oils); and preservatives (such as, methyl or propyl-p hydroxybenzoates or sorbic acid). The preparations also can contain buffer salts, flavoring, coloring and/or sweetening agents as appropriate.

Preparations for oral administration can be formulated to give controlled or sustained release or for release after passage through the stomach or in the small intestine of the active compound. For oral administration the compositions can take the form of tablets, capsules, liquids, lozenges and other forms suitable for oral administration. Formulations suitable for oral administration include lozenges and other formulations that deliver the pharmaceutical composition to the mucosa of the mouth, throat and/or gastrointestinal tract. Lozenges can be formulated with suitable ingredients including excipients for example, anhydrous crystalline maltose and magnesium stearate. As noted, modified polypeptides described herein exhibit resistance to blood or intestinal proteases.

The compositions for oral administration can be formulated, for example, as gastro-resistant capsules or tablets. Such gastro-resistant capsules are modified release capsules that are intended to resist the gastric fluid and to release their active ingredient or ingredients in the intestinal fluid. They are prepared by providing hard or soft capsules with a gastro-resistant shell (enteric capsules) or by filling capsules with granules or with particles covered with a gastro-resistant coating.

The enteric coating is typically, although not necessarily, a polymeric material. Enteric coating materials can contain bioerodible, gradually hydrolyzable and/or gradually water-soluble polymers. The "coating weight," or relative amount of coating material per capsule, generally dictates the time interval between ingestion and drug release. Any coating should be applied to a sufficient thickness such that the entire coating does not dissolve in the gastrointestinal fluids at pH below about 5, but does dissolve at pH about 5 and above. It is expected that any anionic polymer exhibiting a pH-dependent solubility profile can be used as an enteric coating to achieve delivery of the active ingredient to the lower gastrointestinal tract. The selection of the specific enteric coating material will depend on the following properties: resistance to dissolution and disintegration in the stomach; impermeability to gastric fluids and drug/carrier/enzyme while in the stomach; ability to dissolve or disintegrate rapidly at the target intestine site; physical and chemical stability during storage; non-toxicity; ease of application as a coating (substrate friendly); and economical practicality.

Suitable enteric coating materials include, but are not limited to: cellulosic polymers, such as hydroxypropyl cellulose, hydroxyethyl cellulose, hydroxypropyl methyl cellulose, methyl cellulose, ethyl cellulose, cellulose acetate, cellulose acetate phthalate, cellulose acetate trimellitate, hydroxypropylmethyl cellulose phthalate, hydroxypropylmethyl cellulose succinate and carboxymethylcellulose sodium; acrylic acid polymers and copolymers, such as formed from acrylic acid, met acrylic acid, methyl acrylate, ammonium methylacrylate, ethyl acrylate, methyl methacrylate and/or ethyl methacrylate (such as, those copolymers sold under the trade name EUDRAGIT); vinyl polymers and copolymers, such as polyvinyl pyrrolidone (PVP), polyvinyl acetate, polyvinyl acetate phthalate, vinyl acetate crotonic acid copolymer, and ethylene-vinyl acetate copolymers; and shellac (purified lac). Combinations of different coating materials also can be used to coat a single capsule. Exemplary of such gastro-resistant capsules are hard gelatin capsules (sold by Torpac or Capsugel) size 9, coated with cellulose acetate phthalate (CAP) at 12% in acetone.

The enteric coating provides for controlled release of the active agent, such that drug release can be accomplished at some generally predictable location in the lower intestinal tract below the point at which drug release would occur without the enteric coating. The enteric coating also prevents exposure of the hydrophilic therapeutic agent and carrier to the epithelial and mucosal tissue of the buccal cavity, pharynx, esophagus, and stomach, and to the enzymes associated with these tissues. The enteric coating therefore helps to protect the active agent and a patient's internal tissue from any adverse event prior to drug release at the desired site of delivery. Furthermore, the coated capsules can permit optimization of drug absorption, active agent protection, and safety. Multiple enteric coatings targeted to release the active agent at various regions in the lower gastrointestinal tract would enable even more effective and sustained improved delivery throughout the lower gastrointestinal tract.

The coating optionally can contain a plasticizer to prevent the formation of pores and cracks that would permit the penetration of the gastric fluids. Suitable plasticizers include, but are not limited to, triethyl citrate (CITROFLEX 2), triacetin (glyceryl triacetate), acetyl triethyl citrate (CITROFLEC A2), CARBOWAX 400 (polyethylene glycol 400), diethyl phthalate, tributyl citrate, acetylated monoglycerides, glycerol, fatty acid esters, propylene glycol, and dibutyl phthalate. In particular, a coating comprised of an anionic carboxylic acrylic polymer will typically contain less than about 50% by weight, such as less than about 30%, 10% to about 25% by weight, based on the total weight of the coating, of a plasticizer, particularly dibutyl phthalate, polyethylene glycol, triethyl citrate and triacetin. The coating also can contain other coating excipients, such as detackifiers, antifoaming agents, lubricants (such as, magnesium stearate), and stabilizers (such as, hydroxypropylcellulose, acids and bases) to solubilize or disperse the coating material, and to improve coating performance and the coated product.

The coating can be applied to the capsule or tablet using conventional coating methods and equipment. For example, an enteric coating can be applied to a capsule using a coating pan, an airless spray technique, fluidized bed coating equipment, or the like. Detailed information concerning materials, equipment and processes for preparing coated dosage forms are described in *Pharmaceutical Dosage Forms: Tablets*, eds. Lieberman et al. (New York: Marcel Dekker, Inc., 1989), and in Ansel et al., *Pharmaceutical Dosage Forms and Drug Delivery Systems*, $6^{th}$ Edition (Media, Pa.: Williams & Wilkins, 1995). The coating thickness, as noted above, must be sufficient to ensure that the oral dosage form remains intact until the desired site of topical delivery in the lower intestinal tract is reached.

Preparations for oral administration can be formulated to give controlled or sustained release or for release after passage through the stomach or in the small intestine of the active compound. For oral administration the compositions can take the form of tablets, capsules, liquids, lozenges and other forms suitable for oral administration Formulations suitable for oral administration include lozenges and other formulations that deliver the pharmaceutical composition to the mucosa of the mouth, throat and/or gastrointestinal tract. Lozenges can be formulated with suitable ingredients including excipients for example, anhydrous crystalline maltose and magnesium stearate. As noted, modified polypeptides herein exhibit resistance to blood or intestinal proteases and can exhibit increased half-life in the gastrointestinal tract. Thus, preparations of oral administration can be suitably formulated without additional protease inhibitors or other protective compounds, such as a Bowman-Birk inhibitor, a conjugated Bowman-Birk inhibitor, aprotinin and camostat. Preparations for oral administration also can include a modified FIX resistant to proteolysis formulated with one or more additional ingredients that also confer proteases resistance, or confer stability in other conditions, such as particular pH conditions.

2. Administration of Nucleic Acids Encoding Modified FIX Polypeptides (Gene Therapy)

Also provided are compositions of nucleic acid molecules encoding the modified FIX polypeptides and expression vectors encoding them that are suitable for gene therapy. Rather than deliver the protein, nucleic acid can be administered in vivo, such as systemically or by other route, or ex vivo, such as by removal of cells, including lymphocytes, introduction of the nucleic therein, and reintroduction into the host or a compatible recipient.

Modified FIX polypeptides can be delivered to cells and tissues by expression of nucleic acid molecules. Modified FIX polypeptides can be administered as nucleic acid molecules encoding modified FIX polypeptides, including ex vivo techniques and direct in vivo expression. Nucleic acids can be delivered to cells and tissues by any method known to those of skill in the art. The isolated nucleic acid sequences can be incorporated into vectors for further manipulation.

Methods for administering modified FIX polypeptides by expression of encoding nucleic acid molecules include administration of recombinant vectors. The vector can be designed to remain episomal, such as by inclusion of an origin of replication or can be designed to integrate into a chromosome in the cell. Modified FIX polypeptides also can be used in ex vivo gene expression therapy using non-viral vectors. For example, cells can be engineered to express a modified FIX polypeptide, such as by integrating a modified FIX polypeptide encoding-nucleic acid into a genomic location, either operatively linked to regulatory sequences or such that it is placed operatively linked to regulatory sequences in a genomic location. Such cells then can be administered locally or systemically to a subject, such as a patient in need of treatment.

Viral vectors, include, for example adenoviruses, adeno-associated viruses (AAV), poxviruses, herpes viruses, retroviruses and others designed for gene therapy can be employed. The vectors can remain episomal or can integrate into chromosomes of the treated subject. A modified FIX polypeptide can be expressed by a virus, which is administered to a subject in need of treatment. Viral vectors suitable for gene therapy include adenovirus, adeno-associated virus (AAV), retroviruses, lentiviruses, vaccinia viruses and others noted above. For example, adenovirus expression technology is well-known in the art and adenovirus production and administration methods also are well known. Adenovirus serotypes are available, for example, from the American Type Culture Collection (ATCC, Rockville, Md.). Adenovirus can be used ex vivo, for example, cells are isolated from a patient in need of treatment, and transduced with a modified FIX polypeptide-expressing adenovirus vector. After a suitable culturing period, the transduced cells are administered to a subject, locally and/or systemically. Alternatively, modified. FIX polypeptide-expressing adenovirus particles are isolated and formulated in a pharmaceutically-acceptable carrier for delivery of a therapeutically effective amount to prevent, treat or ameliorate a disease or condition of a subject. Typically, adenovirus particles are delivered at a dose ranging from 1 particle to 1014 particles per kilogram subject weight, generally between 106 or 108 particles to 1012 particles per kilogram subject weight. In some situations it is desirable to provide a nucleic acid source with an agent that targets cells, such as an antibody specific for a cell surface membrane protein or a target cell, or a ligand for a receptor on a target cell. FIX also can be targeted for delivery into specific cell types. For example, adenoviral vectors encoding FIX polypeptides can be used for stable expression in nondividing cells, such as liver cells, and skeletal muscle cells (Arruda et al. (2001) *Blood* 97(1): 130-138 and Yao et al. (1992) *PNAS* 89: 3357-3361). In another example, viral or nonviral vectors encoding FIX polypeptides can be transduced into isolated cells for subsequent delivery. Additional cell types for expression and delivery of FIX are known in the art and include but are not limited to, fibroblasts and endothelial cells (Palmer et al. (1989) *Blood* 73: 438-445; Yao et al. (1991) *PNAS* 88: 8101-8105).

The nucleic acid molecules can be introduced into artificial chromosomes and other non-viral vectors. Artificial chromosomes, such as ACES (see, Lindenbaum et al. *Nucleic Acids Res.* 2004 Dec. 7; 32(21):e172) can be engineered to encode and express the isoform. Briefly, mammalian artificial chromosomes (MACs) provide a means to introduce large payloads of genetic information into the cell in an autonomously replicating, non-integrating format. Unique among MACs, the mammalian satellite DNA-based Artificial Chromosome Expression (ACE) can be reproducibly generated de novo in cell lines of different species and readily purified from the host cells' chromosomes. Purified mammalian ACEs can then be reintroduced into a variety of recipient cell lines where they have been stably maintained for extended periods in the absence of selective pressure using an ACE System. Using this approach, specific loading of one or two gene targets has been achieved in LMTK(−) and CHO cells.

Another method for introducing nucleic acids encoding the modified FIX polypeptides is a two-step gene replacement technique in yeast, starting with a complete adenovirus genome (Ad2; Ketner et al. (1994) *Proc. Natl. Acad. Sci. USA* 91: 6186-6190) cloned in a Yeast Artificial Chromosome (YAC) and a plasmid containing adenovirus sequences to target a specific region in the YAC clone, an expression cassette for the gene of interest and a positive and negative selectable marker. YACs are of particular interest because they permit incorporation of larger genes. This approach can be used for construction of adenovirus-based vectors bearing nucleic acids encoding any of the described modified FIX polypeptides for gene transfer to mammalian cells or whole animals.

The nucleic acids can be encapsulated in a vehicle, such as a liposome, or introduced into cells, such as a bacterial cell, particularly an attenuated bacterium or introduced into a viral vector. For example, when liposomes are employed, proteins that bind to a cell surface membrane protein associated with endocytosis can be used for targeting and/or to facilitate uptake, such as capsid proteins or fragments thereof tropic for a particular cell type, antibodies for proteins which undergo internalization in cycling, and proteins that target intracellular localization and enhance intracellular half-life.

For ex vivo and in vivo methods, nucleic acid molecules encoding the modified FIX polypeptide is introduced into cells that are from a suitable donor or the subject to be treated. Cells into which a nucleic acid can be introduced for purposes of therapy include, for example, any desired, available cell type appropriate for the disease or condition to be treated, including but not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, such as, such as stem cells obtained from bone marrow, umbilical cord blood, peripheral blood, fetal liver, and other sources thereof.

For ex vivo treatment, cells from a donor compatible with the subject to be treated or the subject to be treated cells are removed, the nucleic acid is introduced into these isolated cells and the modified cells are administered to the subject. Treatment includes direct administration, such as, for example, encapsulated within porous membranes, which are implanted into the patient (see, such as, U.S. Pat. Nos. 4,892, 538 and 5,283,187 each of which is herein incorporated by reference in its entirety). Techniques suitable for the transfer of nucleic acid into mammalian cells in vitro include the use of liposomes and cationic lipids (such as, DOTMA, DOPE and DC-Chol) electroporation, microinjection, cell fusion, DEAE-dextran, and calcium phosphate precipitation methods. Methods of DNA delivery can be used to express modified FIX polypeptides in vivo. Such methods include liposome delivery of nucleic acids and naked DNA delivery, including local and systemic delivery such as using electroporation, ultrasound and calcium-phosphate delivery. Other techniques include microinjection, cell fusion, chromosome-mediated gene transfer, microcell-mediated gene transfer and spheroplast fusion.

In vivo expression of a modified FIX polypeptide can be linked to expression of additional molecules. For example, expression of a modified FIX polypeptide can be linked with expression of a cytotoxic product such as in an engineered virus or expressed in a cytotoxic virus. Such viruses can be targeted to a particular cell type that is a target for a therapeutic effect. The expressed modified FIX polypeptide can be used to enhance the cytotoxicity of the virus.

In vivo expression of a modified FIX polypeptide can include operatively linking a modified FIX polypeptide encoding nucleic acid molecule to specific regulatory sequences such as a cell-specific or tissue-specific promoter. Modified FIX polypeptides also can be expressed from vectors that specifically infect and/or replicate in target cell types and/or tissues. Inducible promoters can be used to selectively regulate modified FIX polypeptide expression. An exemplary regulatable expression system is the doxycycline-inducible gene expression system, which has been used to regulate recombinant FIX expression (Srour et al. *Thromb Haemost.* 90(3): 398-405 (2003)).

Nucleic acid molecules, as naked nucleic acids or in vectors, artificial chromosomes, liposomes and other vehicles can be administered to the subject by systemic administration, topical, local and other routes of administration. When systemic and in vivo, the nucleic acid molecule or vehicle containing the nucleic acid molecule can be targeted to a cell. Administration also can be direct, such as by administration of a vector or cells that typically targets a cell or tissue. For example, tumor cells and proliferating cells can be targeted cells for in vivo expression of modified FIX polypeptides. Cells used for in vivo expression of a modified FIX polypeptide also include cells autologous to the patient. Such cells can be removed from a patient, nucleic acids for expression of an modified FIX polypeptide introduced, and then administered to a patient such as by injection or engraftment.

Polynucleotides and expression vectors provided herein can be made by any suitable method. Further provided are nucleic acid vectors comprising nucleic acid molecules as described above, including a nucleic acid molecule comprising a sequence of nucleotides that encodes the polypeptide as set forth in any of SEQ ID NOS: 3-891, 917-1034, 1036-2044 or a fragment thereof. Further provided are nucleic acid vectors comprising nucleic acid molecules as described above and cells containing these vectors.

I. THERAPEUTIC USES

The modified FIX polypeptides and nucleic acid molecules provided herein can be used for treatment of any condition for which unmodified FIX is employed. Modified FIX polypeptides have therapeutic activity alone or in combination with other agents. The modified polypeptides provided herein are designed to retain therapeutic activity but exhibit modified properties, particularly increased stability. Such modified properties, for example, can improve the therapeutic effectiveness of the polypeptides and/or can provide for additional routes of administration, such as oral administration. The modified FIX polypeptides and encoding nucleic acid molecules provided herein can be used for treatment of any condition for which unmodified FIX is employed. This section provides exemplary uses of and administration methods. These described therapies are exemplary and do not limit the applications of modified FIX polypeptides.

The modified FIX polypeptides provided herein can be used in various therapeutic as well as diagnostic methods in which FIX is employed. Such methods include, but are not limited to, methods of treatment of physiological and medical conditions described and listed below. Modified FIX polypeptides provided herein can exhibit improvement of in vivo activities and therapeutic effects compared to wild-type FIX, including lower dosage to achieve the same effect, a more sustained therapeutic effect and other improvements in administration and treatment.

The modified FIX polypeptides described herein exhibit increased protein stability and improved half-life. Thus, modified FIX polypeptides can be used to deliver longer-lasting, more stable therapies. Examples of therapeutic improvements using modified FIX polypeptides include, but are not limited to, lower dosages, fewer and/or less frequent administrations, decreased side effects and increased therapeutic effects.

In particular, modified FIX polypeptides, are intended for use in therapeutic methods in which FIX has been used for treatment. Such methods include, but are not limited to, methods of treatment of diseases and disorders, such as, but not limited to, blood coagulation disorders, hematologic diseases, hemorrhagic disorders, hemophilias, in particular hemophilia B, and acquired blood disorders, such as caused by liver disease. Modified FIX polypeptides also can be used in the treatment of additional bleeding diseases and disorders, such as, but not limited to, thrombocytopenia (such as, idiopathic thrombocytopenic purpura, and thrombotic thrombocytopenic purpura), Von Willebrand's disease, hereditary platelet disorders (such as, storage pool disease such as Chediak-Higashi and Hermansky-Pudlak syndromes, thromboxane A2 dysfunction, thromboasthenia, and Bernard-Soulier syndrome), hemolytic-uremic syndrome, Hereditary Hemorhhagic Telangiectsia, also known as Rendu-Osler-Weber syndrome, allergic purpura (Henoch Schonlein purpura) and disseminated intravascular coagulation. In some embodiments, the bleedings to be treated by FIX polypeptides occur in organs such as the brain, inner ear region, eyes, liver, lung, tumor tissue, gastrointestinal tract. In other embodiments, the bleeding is diffuse, such as in haemorrhagic gastritis and profuse uterine bleeding. Patients with bleeding disorders are often at risk for hemorrhage and excessive bleeding during surgery or trauma. Such patients often have acute haemarthroses (bleedings in joints), chronic haemophilic arthropathy, haematomas, (such as, muscular, retroperitoneal, sublingual and retropharyngeal), bleedings in other tissue, haematuria (bleeding from the renal tract), cerebral hemorrhage, surgery (such as, hepatectomy), dental extraction, and gastrointestinal bleedings (such as, UGI bleeds), that can be treated with modified FIX polypeptides. In one embodiment, the modified FIX polypeptides can be used to treat bleeding episodes due to trauma, or surgery, or lowered count or activity of platelets, in a subject. Exemplary methods for patients undergoing surgery include treatments to prevent hemorrhage and treatments before, during, or after surgeries such as, but not limited to, heart surgery, angioplasty, lung surgery, abdominal surgery, spinal surgery, brain surgery, vascular surgery, dental surgery, or organ transplant surgery, including transplantation of heart, lung, pancreas, or liver.

FIX polypeptides lacking functional peptidase activity have been used in therapeutic methods to inhibit blood coagulation (U.S. Pat. No. 6,315,995). Modified FIX polypeptides provided herein that inhibit or antagonize blood coagulation can be used in anticoagulant methods of treatment for ischemic disorders, such as a peripheral vascular disorder, a pulmonary embolus, a venous thrombosis, deep vein thrombosis (DVT), superficial thrombophlebitis (SVT), arterial thrombosis, a myocardial infarction, a transient ischemic attack, unstable angina, a reversible ischemic neurological deficit, an adjunct thrombolytic activity, excessive clotting conditions, reperfusion injury, sickle cell anemia or stroke disorder. In patients with an increased risk of excessive clotting, such as DVT or SVT, during surgery, protease inactive modified FIX polypeptides provided herein can be administered to prevent excessive clotting in surgeries, such as, but not limited to heart surgery, angioplasty, lung surgery, abdominal surgery, spinal surgery, brain surgery, vascular surgery, or organ transplant surgery, including transplantation of heart, lung, pancreas, or liver. In some cases treatment is performed with FIX alone. In some cases, FIX is administered in conjunction with additional coagulation or anticoagulation factors as required by the condition or disease to be treated.

Treatment of diseases and conditions with modified FIX polypeptides can be effected by any suitable route of administration using suitable formulations as described herein including, but not limited to, injection, pulmonary, oral and transdermal administration. If necessary, a particular dosage and duration and treatment protocol can be empirically determined or extrapolated. For example, exemplary doses of recombinant and native FIX polypeptides can be used as a starting point to determine appropriate dosages. For example, a recombinant FIX polypeptide, BeneFIX®, has been administered to patients with hemophilia B, at a dosage of 50 I.U./kg over a 10 minute infusion, resulting in a mean circulating activity of 0.8±0.2 I.U./dL per I.U./kg infused with a mean half-life of 19.4±5.4 hours. Modified FIX polypeptides that are more stable and have an increased half-life in vivo, can be effective at reduced dosage amounts and or frequencies. For example, because of the improvement in properties such as serum stability, dosages can be lower than comparable amounts of unmodified FIX. Dosages for unmodified FIX polypeptides can be used as guidance for determining dosages for modified FIX polypeptides. Factors such as the level of activity and half-life of the modified FIX in comparison to the unmodified FIX can be used in making such determinations. Particular dosages and regimens can be empirically determined.

Dosage levels and regimens can be determined based upon known dosages and regimens, and, if necessary can be extrapolated based upon the changes in properties of the modified polypeptides and/or can be determined empirically based on a variety of factors. Such factors include body weight of the individual, general health, age, the activity of the specific compound employed, sex, diet, time of administration, rate of excretion, drug combination, the severity and course of the disease, and the patient's disposition to the disease and the judgment of the treating physician. The active ingredient, the polypeptide, typically is combined with a pharmaceutically effective carrier. The amount of active ingredient that can be combined with the carrier materials to produce a single dosage form or multi-dosage form can vary depending upon the host treated and the particular mode of administration.

The effect of the FIX polypeptides on the clotting time of blood can be monitored using any of the clotting tests known in the art including, but not limited to, whole blood partial thromboplastin time (PTT), the activated partial thromboplastin time (aPTT), the activated clotting time (ACT), the recalcified activated clotting time, or the Lee-White Clotting time.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms or based upon scheduled dosages. In other cases, additional administrations can be required in response to acute events such as hemorrhage, trauma, or surgical procedures.

The following are some exemplary conditions for which FIX has been used as a treatment agent alone or in combination with other agents.

1. Hemophilia

Hemophilia is a bleeding disorder that is caused by a deficiency in one or more blood coagulation factors. It is characterized by a decreased ability to form blood clots at sites of tissue damage. Congenital X-linked hemophilias include hemophilia A and hemophilia B, or Christmas disease, which are caused by deficiencies in FVIII and FIX, respectively. Hemophilia A occurs at a rate of 1 out of 10,0000 males, while hemophilia B occurs in 1 out of 50,000 males.

Patients with hemophilia suffer from recurring joint and muscle bleeds, which can be spontaneous or in response to trauma. The bleeding can cause severe acute pain, restrict movement, and lead to secondary complications including synovial hypertrophy. Furthermore, the recurring bleeding in the joints can cause chronic synovitis, which can cause joint damage, destroying synovium, cartilage, and bone.

Hemophilia B can be effectively managed with administration of FIX therapeutics. Patients can often achieve normal life span with proper treatment to control bleeding episodes. Administration of FIX can aid in controlling bleeding during surgery, trauma, during dental extraction, or to alleviate bleeding associated with hemarthroses, hematuria, mucocutaneous bleeding, such as epistaxis or gastrointestinal tract bleeding, cystic lesions in subperiosteal bone or soft tissue, or hematomas, which cause neurological complications such as intracranial bleeding, spinal canal bleeding. Death in patients with hemophilia is often the result of bleeding in the central nervous system. Other serious complications in hemophilic patients include development of inhibitors to coagulation factor therapeutics and disease, such as progressive hepatitis with hepatic failure or AIDS caused by use of contaminated blood products.

The most frequent alterations in the FIX gene are point mutations, in particular missense mutations. Most of the identified FIX mutations occur in amino acid residues in the coding region of the FIX gene, often affecting evolutionarily conserved amino acids. The severity of the hemophilia depends upon the nature of the mutation. Mutations in the coding region can affect a number of different properties or activities of the FIX polypeptide including alteration of protease activity, cofactor binding, signal peptide or propeptide cleavage, post-translational modifications, and inhibition of cleavage of FIX into its activated form. Other types of point mutations include nonsense mutations that produce an unstable truncated FIX polypeptide, and frameshift mutations (small deletions and insertions) that result in a terminally aberrant FIX molecule. In addition, FIX point mutations can be found in the promoter region, which can disrupt the recognition sequences for several specific gene regulatory proteins, resulting in reduced transcription of coagulation factor IX. Decreased FIX as a result of transcriptional abnormalities is called Hemophilia B Leyden. An exemplary mutation in the promoter region includes disruption of the HNF-4 binding site, which affect regulation of FIX transcription by the androgen receptor. The severity of this type of hemophilia is governed by the levels of androgen in the blood, which increase during puberty and partially alleviate the FIX transcriptional deficiency (Kurachi et al. (1995)). Other missense nucleotide changes affect the processing of factor IX primary RNA transcript. For example, some mutations occur at evolutionarily conserved donor-splice (GT), and acceptor-splice (AG) consensus sequences, which can create cryptic splice junctions and disrupt assembly of spliceosomes. Some severe cases of hemophilia (approximately 10%) present with large deletions in the FIX gene (Gianelli et al. (1998). Treatment of FIX deficiency most often involves administration of FIX in the form of purified plasma concentrates, purified FIX preparations, or recombinant forms of FIX. Occasionally patients with large deletions produce anti-FIX antibodies, or inhibitors, in response to replacement therapy (Gianelli et al. (1983)). Among purified FIX therapeutics available for the treatment of hemophilia are: MonoNine® (Aventis Behring), Alpha-nine-SD® (Alpha therapeutic), and BeneFix® (Genetics Institute). MonoNine® and Alpha-nine-SD® are FIX preparations derived from human plasma, while BeneFix® is a recombinant FIX generated from the native FIX polypeptide sequence. FIX complex therapeutics include Bebulin® VH, a purified concentrate of FIX with FX and low amounts of FVII; Konyne® 80 (Bayer), a purified concentrate of FIX, with FII, FX, and low levels of FVII; PROPLEX® T (Baxter International), a heat treated product prepared from pooled normal human plasma containing FIX with FII, FVII, and FX; and Profilnine SD® (Alpha Therapeutic Corporation), a solvent detergent treated, concentrate of FIX with FII, FX and low levels of FVII. All such products can be modified as described herein and/or replaced with modified FIX polypeptides provided herein.

The modified FIX polypeptides provided herein and the nucleic acids encoding the modified FIX polypeptides provided herein can be used in therapies for hemophilia, including treatment of bleeding conditions associated with hemophilia. The modified FIX polypeptides provided herein can be used, for example, to control or prevent spontaneous bleeding episodes or to control or prevent bleeding in response to trauma or surgical procedures. In one embodiment, the modified FIX polypeptides herein, and nucleic acids encoding modified FIX polypeptides can be used for treatment of hemophilia B. The modified FIX polypeptides herein provide increased protein stability and increased protein half-life. Of particular interest are FIX polypeptides that are resistant to proteases. Thus, modified FIX polypeptides can be used to deliver longer lasting, more stable therapies for hemophilia. Examples of therapeutic improvements using modified FIX polypeptides include for example, but are not limited to, lower dosages, fewer and/or less frequent administrations, decreased side effects, and increased therapeutic effects.

Modified FIX polypeptides can be tested for therapeutic effectiveness, for example, by using animal models. For example FIX-deficient mice, or any other known disease model for hemophilia, can be treated with modified FIX polypeptides. Progression of disease symptoms and phenotypes is monitored to assess the effects of the modified FIX polypeptides. Modified FIX polypeptides also can be administered to animal models as well as subjects such as in clinical trials to assess in vivo effectiveness in comparison to placebo controls and/or controls using unmodified FIX.

The modified FIX polypeptide can be used to deliver longer lasting, more stable hemophilia B therapies. Thus, the modified FIX polypeptides provided herein can be administered at lower dosages and/or less frequently then unmodified or native FIX polypeptides, such as MonoNine® or Alphanine-SD®, or recombinant forms of FIX, such as BeneFix®, while retaining one or more therapeutic activities and/or having one or more fewer/decreased side effects.

2. Thrombotic Diseases and Conditions

Thrombotic diseases are characterized by hypercoagulation, or the deregulation of hemostasis in favor of development of blot clots. Exemplary thrombotic diseases and conditions include arterial thrombosis, venous thrombosis, venous thromboembolism, pulmonary embolism, deep vein thrombosis, stroke, ischemic stroke, myocardial infarction, unstable angina, atrial fibrillation, renal damage, percutaneous translumenal coronary angioplasty, disseminated intravascular coagulation, sepsis, artificial organs, shunts or prostheses, and other acquired thrombotic diseases, as discussed below. Typical therapies for thrombotic diseases involve anticoagulant therapies, including inhibition of the coagulation cascade.

The modified FIX polypeptides provided herein and the nucleic acids encoding the modified FIX polypeptides provided herein can be used in anticoagulant therapies for thrombotic diseases and conditions, including treatment of conditions involving intravascular coagulation. The modified FIX polypeptides provided herein that can inhibit blood coagulation can be used, for example, to control or prevent formation of thromboses. In a particular embodiment, the modified FIX polypeptides herein, and nucleic acids encoding modified FIX polypeptides can be used for treatment of an arterial thrombotic disorder. In another embodiment, the modified FIX polypeptides herein, and nucleic acids encoding modified FIX polypeptides can be used for treatment of a venous thrombotic disorder, such as deep vein thrombosis. In a particular embodiment, the modified FIX polypeptides herein, and nucleic acids encoding modified FIX polypeptides can be used for treatment of an ischemic disorder, such as stroke. The modified FIX polypeptides herein provide increased protein stability and increased protein half-life. Of particular interest are FIX polypeptides that are resistant to proteases. Thus, modified FIX polypeptides can be used to deliver longer lasting, more stable therapies for thrombotic diseases and conditions. Examples of therapeutic improvements using modified FIX polypeptides include for example, but are not limited to, lower dosages, fewer and/or less frequent administrations, decreased side effects, and increased therapeutic effects. Modified FIX polypeptides can be tested for therapeutic effectiveness, for example, by using animal models. For example mouse models of ischemic stroke, or any other known disease model for a thrombotic disease or condition, can be treated with modified FIX polypeptides (Dodds (1987) *Ann NY Acad Sci* 516: 631-635). Progression of disease symptoms and phenotypes is monitored to assess the effects of the modified FIX polypeptides. Modified FIX polypeptides also can be administered to animal models as well as subjects such as in clinical trials to assess in vivo effectiveness in comparison to placebo controls and/or controls using unmodified FIX.

a. Arterial Thrombosis

Arterial thrombi form as a result of a rupture in the arterial vessel wall. Most often the rupture occurs in patients with vascular disease, such as atherosclerosis. The arterial thrombi usually form in regions of disturbed blood flow and at sites of rupture due to an atherosclerotic plaque, which exposes the thrombogenic subendothelium to platelets and coagulation proteins, which in turn activate the coagulation cascade. Plaque rupture may also produce further narrowing of the blood vessel due to hemorrhage into the plaque. Nonocclusive thrombi can become incorporated into the vessel wall and can accelerate the growth of atherosclerotic plaques. Formation arterial thrombi can result in ischemia either by obstructing flow or by embolism into the distal microcirculation. Anticoagulants and drugs that suppress platelet function and the coagulation cascade can be effective in the prevention and treatment of arterial thrombosis. Such classes of drugs are effective in the treatment of arterial thrombosis. Arterial thrombosis can lead to conditions of unstable angina and acute myocardial infarction. Modified FIX polypeptides provided herein that inhibit coagulation can be used in the treatment and/or prevention of arterial thrombosis and conditions, such as unstable angina and acute myocardial infarction.

b. Venous Thrombosis and Thromboembolism

Venous thrombosis is a condition in the which a blood clot forms in a vein due to imbalances in the signals for clot formation versus clot dissolution, especially in instances of low blood flow through the venous system. Results of thrombus formation can include damage to the vein and valves of the vein, though the vessel wall typically remains intact. The clots can often embolize, or break off, and travel through the blood stream where they can lodge into organ areas such as the lungs (pulmonary embolism), brain (ischemic stroke, transient ischemic attack), heart (heart attack/myocardial infarction, unstable angina), skin (purpura fulminans), and adrenal gland. In some instances the blockage of blood flow can lead to death. Patients with a tendency to have recurrent venous thromboembolism are characterized as having thrombophilia. Risk factors for developing thromboembolic disease include trauma, immobilization, malignant disease, heart failure, obesity, high levels of estrogens, leg paralysis, myocardial infarction, varicose veins, cancers, dehydration, smoking, oral contraceptives, and pregnancy. Genetic studies of families with thrombophilia have shown inheritable high levels coagulation factors, including FVIII, FIX, and FXI (Lavigne et al. (2003) *J. Thromb. Haemost.* 1:2134-2130).

Deep vein thrombosis (DVT) refers the formation of venous blot clot in the deep leg veins. The three main factors that contribute to DVT are injury to the vein lining, increased tendency for the blood to clot and slowing of blood flow. Collectively, these factor are called Virchow's triad. Veins can become injured during trauma or surgery, or as a result of disease condition, such as Buerger's disease or DIC, or another clot. Other contributing factors to development of DVT are similar to that of more general thromboembolic diseases as discussed above. The clot that forms in DVT causes only minor inflammation, thus, allowing it to break loose into the blood stream more easily. Often the thrombus can break off as a result of minor contraction of the leg muscles. Once the thrombus becomes an embolus it can become lodged into vessels of the lungs where is can cause a pulmonary infarction. Patients with high levels of active FIX in their bloodstream are at an increased risk of developing deep vein thrombosis (Weltermann et al. (2003) *J. Thromb. Haemost.* 1(1): 16-18).

Thromboembolic disease can be hereditary, wherein the disease is caused by hereditary abnormalities in clotting factors, thus leading to the imbalance in hemostasis. Several congenital deficiencies include antithrombin III, protein C, protein S, or plasminogen. Other factors include resistance to activated protein C (also termed APC resistance or Factor V leiden effect, in which a mutation in factor V makes it resistant to degradation by protein C), mutation in prothrombin, dysfibrinogemia (mutations confer resistance to fibrinolysis), and hyperhomocysteinemia. Development of thrombombolic disease in younger patients is most often due to the congenital defects described above and is called Juvenile Thrombophilia.

Treatments for venous thromboembolic disease and DVT typically involve anticoagulant therapy, in which oral doses of heparin and warfarin are administered. Heparin is usually infused into patients to control acute events, followed by longer term oral anticoagulant therapy with warfarin to control future episodes. Other therapies include direct thrombin inhibitors, inhibitors of platelet function, such as aspirin and dextran, and therapies to counteract venous stasis, including compression stockings and pneumatic compression devices. Modified FIX polypeptides provided herein that inhibit blood coagulation can be used in anticoagulant therapies for thromboembolic disease and/or DVT. In some embodiments, modified FIX polypeptides provided herein that inhibit blood coagulation can be used in prevention therapies for thromboembolic disease and/or DVT in patients exhibiting risk factors for thromboembolic disease and/or DVT. Modified FIX polypeptides provided herein that inhibit coagulation can be used in anticoagulation therapies for thromboembolic disease and/or DVT due to high levels of FIX in the blood stream.

i. Ischemic Stroke

Ischemic stroke occurs when the blood flow to the brain is interrupted, wherein the sudden loss of circulation to an area of the brain results in a corresponding loss of neurologic function. In contrast to a hemorrhagic stroke, which is characterized by intracerebral bleeding, an ischemic stroke is usually caused by thrombosis or embolism. Ischemic strokes account for approximately 80% of all strokes. In addition to the causes and risk factors for development a thromboembolism as discussed above, processes that cause dissection of the cerebral arteries (such as, trauma, thoracic aortic dissection, arteritis) can cause thrombotic stroke. Other causes include hypoperfusion distal to a stenotic or occluded artery or hypoperfusion of a vulnerable watershed region between 2 cerebral arterial territories. Treatments for ischemic stroke involve anticoagulant therapy for the prevention and treatment of the condition. Modified FIX polypeptides provided herein that inhibit coagulation can be used in the treatment and/or prevention or reduction of risk of ischemic stroke.

3. Acquired Coagulation Disorders

Acquired coagulation disorders are the result of conditions or diseases, such as vitamin K deficiency, liver disease, disseminated intravascular coagulation (DIC), or development of circulation anticoagulants. The defects in blood coagulation are the result of secondary deficiencies in clotting factors caused by the condition or disease. For example, production of coagulation factors from the liver is often impaired when the liver is in a diseased state. Along with decreased synthesis of coagulation factors, fibrinolysis becomes increased and thrombocytopenia (deficiency in platelets) is increased. Decreased production of coagulation factors by the liver also can result from fulminant hepatitis or acute fatty liver of pregnancy. Such conditions promote intravascular clotting which consumes available coagulation factors. Modified FIX polypeptides provided herein can be used in the treatment of acquired coagulation disorders in order to alleviate deficiencies in blood clotting factors.

a. Disseminated Intravascular Coagulation (DIC)

Disseminated intravascular coagulation (DIC) is a disorder characterized by a widespread and ongoing activation of coagulation. In DIC, there is a loss of balance between thrombin activation of coagulation and plasmin degradation of blot clots. Vascular or microvascular fibrin deposition as a result can compromise the blood supply to various organs, which can contribute to organ failure. Prolonged activation of the coagulation system impairs the synthesis of new coagulation factors and increases the degradation of existing coagulation factors, thus leading to decreased levels of procoagulant proteins. As a result, patients with DIC are at an increased risk of serious bleeding, especially during surgery and trauma situations. In acute, massive DIC, thrombocytopenia and depletion of coagulation factors, which promote severe bleeding, are accompanied by secondary fibrinolysis, wherein fibrin degradation products are generated that interfere with normal platelet function and impairs proper fibrin formation. The fibrinolysis is associated with high levels of plasmin which also contributes to the hemorrhagic state by degradation of coagulation factors, such as FIX, FVII, and FV. Treatments for acute DIC, therefore, aid in correcting the coagulation factor deficiencies in order to restore normal coagulation. In sub-acute or chronic DIC, patients present with a more hypercoagulatory phenotype, with thromboses from excess thrombin formation, and the symptoms and signs of venous thrombosis can be present. In contrast to acute DIC, sub-acute or chronic DIC is treated by methods of alleviating the hyperthrombosis, including heparin, anti-thrombin III and activated protein C treatment.

The modified FIX polypeptides provided herein and the nucleic acids encoding the modified FIX polypeptides provided herein can be used in therapies for acute DIC. In one embodiment, the modified FIX polypeptides herein, and nucleic acids encoding modified FIX polypeptides can be used in combination with other coagulation factors to treat deficiencies in clotting factors caused by acute DIC. The modified FIX polypeptides herein provide increased protein stability and increased protein half-life. Of particular interest are FIX polypeptides that are resistant to proteases. Thus, modified FIX polypeptides can be used to deliver longer lasting, more stable therapies for DIC. Examples of therapeutic improvements using modified FIX polypeptides include for example, but are not limited to, lower dosages, fewer and/or less frequent administrations, decreased side effects, and increased therapeutic effects. Modified FIX polypeptides can be tested for therapeutic effectiveness, for example, by using animal models. For example FIX-deficient mice, or any other known disease model for DIC, can be treated with modified FIX polypeptides. Progression of disease symptoms and phenotypes is monitored to assess the effects of the modified FIX polypeptides. Modified FIX polypeptides also can be administered to animal models as well as subjects such as in clinical trials to assess in vivo effectiveness in comparison to placebo controls and/or controls using unmodified FIX.

b. Bacterial Infection and Periodontitis

Systemic infection with microorganisms, such as bacteria, are commonly associated with DIC. The upregulation of coagulation pathways can be mediated in part by cell membrane components of the microorganism (lipopolysaccharide or endotoxin) or bacterial exotoxins (such as staphylococcal alpha toxin) that cause inflammatory responses leading to elevated levels of cytokines. The cytokines, in turn, can influence induction of coagulation.

Bacterial pathogens, such as *Porphyrus gingivalis*, are well-known as causative agents for adult periodontitis. The *Porphyrus gingivalis* bacterium produces arginine-specific cysteine proteinases that function as virulence factors (Grenier et al. (1987) *J. Clin. Microbiol.* 25:738-740, Smalley et al. (1989) *Oral Microbiol. Immunol.* 4:178-181, Marsh, et al. (1989) *FEMS Microbiol.* 59:181-185, and Potempa et al. (1998) *J. Biol. Chem.* 273:21648-21657. *Porphyrus gingivalis* generated two proteinases that are referred to as 50 kDa and 95 kDa gingipains R (RgpB and HRgpA, respectively). The protease can proteolytically cleave and hence activate coagulation factors, such as FIX. During bacterial infection release of the gingipains R into the blood stream can thus lead to uncontrolled activation of the coagulation cascade leading to overproduction of thrombin and increase the possibility of inducing disseminated intravascular coagulation (DIC). The large increases in thrombin concentrations can furthermore contribute alveolar bone resorption by osteoclasts at sites of periodontitis.

The modified FIX polypeptides provided herein that inhibit blood coagulation, and nucleic acids encoding modified FIX polypeptides can be used in treatment of periodontitis. The modified FIX polypeptides herein provide increased protein stability and improved half-life. Thus, modified FIX polypeptides can be used to deliver longer lasting, more stable therapies. Examples of therapeutic improvements using modified FIX polypeptides include, for example, but are not limited to, lower dosages, fewer and/or less frequent administrations, decreased side effects and increased therapeutic effects. Modified FIX polypeptides can be tested for therapeutic effectiveness for airway responsiveness in periodontitis models. Such models are available in animals, such as nonhuman primates, dogs, mice, rats, hamsters, and guinea pigs (Weinberg and Bral (1999) *J. of Periodontology* 26(6), 335-340). Modified FIX polypeptides also can be administered to animal models as well as subjects such as in clinical trials to assess in vivo effectiveness in comparison to placebo controls and/or controls using unmodified FIX.

c. Liver Disease

The liver is the site of production of most coagulation factors of the coagulation cascade. It also is responsible for clearing degraded and inactivated components of coagulation. As such, diseases of the liver can have a profound effect on hemostasis. In some cases, liver disease can be associated with hypersplenism and suppression of platelet production in the bone marrow. Liver disease can be characterized as either an acute or chronic condition. Acute hepatic necrosis is caused by factors, such as infection, shock, or toxins, wherein the necrosis of the liver leads to the inability to produce sufficient quantities of coagulation factors. Chronic liver disease is caused by factors, such as, but not limited to, alcohol, viral infection and autoimmune disease. Hemostatic defects in chronic liver disease include decreased coagulation factors due to decreased production, decreased platelet count due to sequestration in the spleen, and increased fibrin degradation products (FDP) due to decreased clearance, which can lead to conditions, such as DIC, as described above.

The modified FIX polypeptides provided herein and the nucleic acids encoding the modified FIX polypeptides provided herein can be used in therapies for liver disease, including treatment of deficiencies in coagulation factors. The modified FIX polypeptides provided herein can be used, for example, to control or prevent spontaneous bleeding episodes or to control or prevent bleeding in response to trauma or surgical procedures. The modified FIX polypeptides herein provide increased protein stability and increased protein half-life. Of particular interest are FIX polypeptides that are resistant to proteases. Thus, modified FIX polypeptides can be used to deliver longer lasting, more stable therapies for liver disease. Examples of therapeutic improvements using modified FIX polypeptides include for example, but are not limited to, lower dosages, fewer and/or less frequent administrations, decreased side effects, and increased therapeutic effects. Modified FIX polypeptides can be tested for therapeutic effectiveness, for example, by using animal models. For example animal models of autoimmune liver disease and alcohol induced liver disease are available and can be treated with modified FIX polypeptides provided herein (such as Nanji et al. (2003) *Alcohol Res Health.* 27(4):325-30; Heneghan and McFarlane (2005) *Hepatology* 42(1): 149-55). Progression of disease symptoms and phenotypes is monitored to assess the effects of the modified FIX polypeptides. Modified FIX polypeptides also can be administered to animal models as well as subjects such as in clinical trials to assess in vivo effectiveness in comparison to placebo controls and/or controls using unmodified FIX.

c. Warfarin and Heparin-Induced Bleeding

Patients undergoing anticoagulant therapies for the treatment of conditions, such as thromboembolism, can exhibit bleeding episodes upon acute administration of anticoagulants or develop hemorrhagic disorders as a result long term usage of such therapies. Treatments for bleeding episodes typically include administration of procoagulants, such as vitamin K, plasma, concentrates of FIX polypeptides, and protamines to neutralize heparin. The modified FIX polypeptides provided herein can be used in treatments to control bleeding episodes in patients with acquired bleeding disorders due to anticoagulant treatments.

d. Intracerebral Hemorrhage

Intracerebral hemorrhage (ICH) is a type of stroke characterized by spontaneous bleeding into the brain. In contrast to ischemic stroke, which can be treated effectively with anticoagulant therapies, the progressive bleeding induced in ICH is more difficult to treat. Mortality from hemorrhagic stroke at 30 days is seven times higher than ischemic strokes. The most common cause of ICH is degeneration and rupture of small arteries or arterioles due to sustained hypertension. In the elderly, cerebral amyloid angiopathy also can induce ICH Therapies for ICH involves the use of coagulation factor therapies, in particular recombinant factor VII. The modified FIX polypeptides provided herein, either alone or in combination with other coagulation factors, can be used in treatments to control bleeding episodes in patients with ICH.

J. COMBINATION THERAPIES

Any of the modified FIX polypeptides, and nucleic acid molecules encoding modified FIX polypeptides described herein can be administered in combination with, prior to, intermittently with, or subsequent to, other therapeutic agents or procedures including, but not limited to, other biologics, small molecule compounds and surgery. For any disease or condition, including all those exemplified above, for FIX is indicated or has been used and for which other agents and treatments are available, FIX can be used in combination therewith. Hence, the modified FIX polypeptides provided herein similarly can be used. Depending on the disease or condition to be treated, exemplary combinations include, but are not limited to combination with other plasma purified or recombinant coagulation factors, procoagulants, anticoagulants, anti-coagulation antibodies, glycosaminoglycans, heparins, heparinoids, heparin derivatives, heparin-like drugs, coumarins, such as warfarin and coumarin derivatives. Additional procoagulants that can be used in combination therapies with modified FIX polypeptides include, but are not limited to, vitamin K, vitamin K derivatives, and protein C inhibitors. Additional anticoagulants that can be used in combination therapies with modified FIX polypeptides include, but are not limited to, β2 adrenoreceptor antagonists, neuropeptide V2 antagonists, prostacyclin analogs, thromboxane synthase inhibitors, calcium agonists, elastase inhibitors, non-steroidal anti-inflammatory molecules, thrombin inhibitors, lipoxygenase inhibitors, FVIIa inhibitors, FXa inhibitors, phosphodiesterase III inhibitors, fibrinogen, vitamin K antagonists, and glucoprotein IIb/IIa antagonists.

K. ARTICLES OF MANUFACTURE AND KITS

Pharmaceutical compounds of modified FIX polypeptides for nucleic acids encoding modified FIX polypeptides, or a derivative or a biologically active portion thereof can be packaged as articles of manufacture containing packaging material, a pharmaceutical composition which is effective for treating a FIX-mediated disease or disorder, and a label that indicates that modified FIX polypeptide or nucleic acid molecule is to be used for treating a FIX-mediated disease or disorder.

The articles of manufacture provided herein contain packaging materials. Packaging materials for use in packaging pharmaceutical products are well known to those of skill in the art. See, for example, U.S. Pat. Nos. 5,323,907, 5,033,252 and 5,052,558, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any FIX-mediated disease or disorder.

Modified FIX polypeptides and nucleic acid molecules also can be provided as kits. Kits can include a pharmaceutical composition described herein and an item for administration. For example a modified FIX can be supplied with a device for administration, such as a syringe, an inhaler, a dosage cup, a dropper, or an applicator. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of FIX or a FIX regulated system of a subject.

L. EXAMPLES

The following examples are included for illustrative purposes only and are not intended to limit the scope of the embodiments provided herein.

Example 1

Cloning and Generation FIX Mutants

A. Cloning of cDNA Encoding FIX and Insertion into a Mammalian Expression Vector The nucleotide sequence comprising the coding sequence of FIX was cloned into the plasmid pCR-Blunt II-TOPO (Invitrogen, SEQ ID NO: 915) by polymerase chain reaction (PCR), using standard techniques known in the art, from plasmid pCMV5.8 (ATCC Number: 79829), using the following primers: FIXHIND 5'-GCATTAGGATAAGCTTG-GATGCAGCGCGTGAACATG-3' (SEQ ID NO: 913) and FIXXBA 5'-GCATCGGCGCAGATCTCTGT-TAATTTTCAATTCC-3' (SEQ ID NO: 914). After confirming the sequence of the FIX fragment contained in the pTOPO-PCR bluntII plasmid by sequencing, the FIX fragment was subcloned by restriction digest using EcoRI into plasmid pNaut to produce plasmid pNaut-FIX-EcoRI (SEQ ID NO: 916). The encoded mature form of the FIX polypeptide has a sequence of amino acids as set forth in SEQ ID NO: 1035. This sequence differs from SEQ ID NO: 2 at five positions: K39T, L40E, I43K, S44Q and S46V. These changes do not affect the clotting activity of the polypeptide.

B. Generation of FIX Mutants

A collection of pre-designed, targeted mutants was generated such that each individual mutant was created and processed individually, and physically separated from each other and in addressable arrays. 2D-scanning technology, described herein and also described in published U.S. Application Nos. US-2004-0132977-A1 and US 2005-0202438 A1) was used to design and obtain FIX mutants with improved resistance to proteolysis. Is-HITs were identified based upon (1) the protein property to be evolved (such as, resistance to proteolysis or stability); (2) the amino acid sequence; and (3) the properties of individual amino acids.

1. Leads Created for Higher Resistance to Proteolysis of FIX

Variants were designed using 2D-scanning to identify positions conferring resistance to proteolysis. Positions selected (is-HITs) on human FIX (SEQ ID NO: 2) were (numbering corresponds to amino acid positions in the mature FIX polypeptide set forth in SEQ ID NO: 2) Y1, S3, G4, K5, L6, E7, E8, F9, V10, G12, L14, E15, R16, E17, M19, E20, E21, K22, S24, F25, E26, E27, A28, R29, E30, V31, F32, E33, T35, E36, R37, T38, T39, E40, F41, W42, K43, Y45, V46, D47, G48, D49, E52, S53, P55, L57, N58, G59, G60, S61, K63, D64, D65, I66, S68, Y69, E70, W72, P74, F75, G76, F77, E78, G79, K80, E83, L84, D85, V86, T87, I90, K91, N92, G93, R94, E96, F98, K100, S102, A103, D104, K106, V107, V108, S110, T112, E113, G114, Y115, R116, L117, A118, E119, K122, S123, E125, P126, A127, V128, P129, P131, G133, R134, V135, S136, V137, S138, T140, S141, K142, L143, T144, R145, A146, E147, T148, V149, P151, D152, V153, D154, Y155, V156, S158, T159, E160, A161, E162, T163, I164, L165, D166, I168, T169, S171, T172, S174, F175, D177, F178, T179, R180, V181, V182, G183, G184, E185, D186, A187, K188, P189, G190, F192, P193, W194, V196, V197, L198, N199, G200, K201, V202, D203, A204, F205, G207, G208, S209, I210, V211, E213, K214, W215, I216, V217, T218, A219, A220, V223, E224, T225, G226, V227, K228, I229, T230, V231, V232, A233, G234, E235, I238, E239, E240, T241, E242, T244, E245, K247, R248, V250, I251, R252, I253, I254, P255, Y259, A261, A262, I263, K265, Y266, D269, I270, A271, L272, L273, E274, L275, D276, E277, P278, L279, V280, L281, S283, Y284, V285, T286, P287, I288, I290, A291, D292, K293, E294, Y295, T296, I298, F299, L300, K301, F302, G303, S304, G305, Y306, V307, S308, G309, W310, G311, R312, V313, F314, K316, G317, R318, S319, A320, L321, V322, L323, Y325, L326, R327, V328, P329, L330, V331, D332, R333, A334, T335, L337, R338, S339, T340, K341, F342, T343, I344, Y345, M348, F349, A351, G352, F353, E355, G356, G357, R358, D359, S360, G363, D364, S365, G366, G367, P368, V370, T371, E372, V373, E374, G375, T376, S377, F378, L379, T380, G381, I382, I383, S384, W385, G386, E387, E388, A390, M391, K392, G393, K394, Y395, G396, I397, Y398, T399, K400, V401, S402, R403, Y404, V405, W407, I408, K409, E410, K411, T412, K413, L414, and T415. The native amino acid at each of the is-HIT positions listed above was replaced by residues as listed in Table 9.

TABLE 9

| Amino acid at is-HIT | Replacing amino acids |
|---|---|
| R | H, Q |
| E | H, N, Q |
| K | N, Q |
| D | N, Q |
| M | I, V |
| P | A, S |

TABLE 9-continued

| Amino acid at is-HIT | Replacing amino acids |
|---|---|
| Y | I, H |
| F | I, V |
| W | H, S |
| L | I, V |
| N | Q, S |
| A | H, N, Q |
| G | H, N, Q |
| I | H, N, Q |
| S | H, N, Q |
| T | H, N, Q |
| V | H, N, Q |

The FIX variants generated for testing increased resistance to proteolysis are listed in Table 10 (SEQ ID NOS: 3-891, 1025-1034, 1036-1926, and 2035-2044).

TABLE 10

List of human FIX variants for testing increased resistance to proteolysis

| | | | | | | | | | |
|---|---|---|---|---|---|---|---|---|---|
| Y1H | Y1I | S3Q | S3H | S3N | G4Q | G4H | G4N | K5N | K5Q |
| L6I | L6V | E7Q | E7H | E7N | E8Q | E8H | E8N | F9I | F9V |
| V10Q | V10H | V10N | G12Q | G12H | G12N | L14I | L14V | E15Q | E15H |
| E15N | R16H | R16Q | E17Q | E17H | E17N | M19I | M19V | E20Q | E20H |
| E20N | E21Q | E21H | E21N | K22N | K22Q | S24Q | S24H | S24N | F25I |
| F25V | E26Q | E26H | E26N | E27Q | E27H | E27N | A28Q | A28H | A28N |
| R29H | R29Q | E30Q | E30H | E30N | V31Q | V31H | V31N | F32I | F32V |
| E33Q | E33H | E33N | T35Q | T35H | T35N | E36Q | E36H | E36N | R37H |
| R37Q | T38Q | T38H | T38N | T39Q | T39H | T39N | E40Q | E40H | E40N |
| F41I | F41V | W42S | W42H | K43N | K43Q | Y45H | Y45I | V46Q | V46H |
| V46N | D47N | D47Q | G48Q | G48H | G48N | D49N | D49Q | E52Q | E52H |
| E52N | S53Q | S53H | S53N | P55A | P55S | L57I | L57V | N58Q | N58S |
| G59Q | G59H | G59N | G60Q | G60H | G60N | S61Q | S61H | S61N | K63N |
| K63Q | D64N | D64Q | D65N | D65Q | I66Q | I66H | I66N | S68Q | S68H |
| S68N | Y69H | Y69I | E70Q | E70H | E70N | W72S | W72H | P74A | P74S |
| F75I | F75V | G76Q | G76H | G76N | F77I | F77V | E78Q | E78H | E78N |
| G79Q | G79H | G79N | K80N | K80Q | E83Q | E83H | E83N | L84I | L84V |
| D85N | D85Q | V86Q | V86H | V86N | T87Q | T87H | T87N | I90Q | I90H |
| I90N | K91N | K91Q | N92Q | N92S | G93Q | G93H | G93N | R94H | R94Q |
| E96Q | E96H | E96N | F98I | F98V | K100N | K100Q | S102Q | S102H | S102N |
| A103Q | A103H | A103N | D104N | D104Q | K106N | K106Q | V107H | V107Q | V107N |
| V108Q | V108H | V108N | S110Q | S110H | S110N | T112Q | T112H | T112N | E113Q |
| E113H | E113N | G114Q | G114H | G114N | Y115H | Y115I | R116H | R116Q | L117I |
| L117V | A118Q | A118H | A118N | E119Q | E119H | E119N | K122N | K122Q | S123Q |
| S123H | S123N | E125Q | E125H | E125N | P126A | P126S | A127Q | A127H | A127N |
| V128Q | V128H | V128N | P129A | P129S | P131A | P131S | G133Q | G133H | G133N |
| R134H | R134Q | V135Q | V135H | V135N | S136Q | S136H | S136N | V137Q | V137H |
| V137N | S138Q | S138H | S138N | T140Q | T140H | T140N | S141Q | S141H | S141N |
| K142N | K142Q | L143I | L143V | T144Q | T144H | T144N | R145H | R145Q | A146Q |
| A146H | A146N | E147Q | E147H | E147N | T148Q | T148H | T148N | V149Q | V149H |
| V149N | P151A | P151S | D152N | D152Q | V153Q | V153H | V153N | D154N | D154Q |
| Y155H | Y155I | V156Q | V156H | V156N | S158Q | S158H | S158N | T159Q | T159H |
| T159N | E160Q | E160H | E160N | A161Q | A161H | A161N | E162Q | E162H | E162N |
| T163Q | T163H | T163N | I164Q | I164H | I164N | L165I | L165Q | L165H |
| D166N | D166Q | I168Q | I168H | I168N | T169Q | T169H | T169N | S171Q | S171H |
| S171N | T172Q | T172H | T172N | S174Q | S174H | S174N | F175I | F175V | F175H |
| D177N | D177Q | F178I | F178V | F178H | T179Q | T179H | T179N | R180H | R180Q |
| V181Q | V181H | V181N | V182Q | V182H | V182N | G183Q | G183H | G183N | G184Q |
| G184H | G184N | E185Q | E185H | E185N | D186N | D186Q | A187Q | A187H | A187N |
| K188N | K188Q | P189A | P189S | G190Q | G190H | G190N | F192I | F192V | F192H |
| P193A | P193S | W194Q | W194H | W194I | V196Q | V196H | V196N | V197Q | V197H |
| V197N | L198I | L198V | L198Q | L198H | N199Q | N199S | G200Q | G200H | G200N |
| K201N | K201Q | V202Q | V202H | V202N | D203N | D203Q | A204Q | A204H | A204N |
| F205I | F205V | G207Q | G207H | G207N | G208Q | G208H | G208N | S209Q | S209H |
| S209N | I210Q | I210H | I210N | V211Q | V211H | V211N | E213Q | E213H | E213N |
| K214N | K214Q | W215S | W215H | I216Q | I216H | I216N | V217Q | V217H | V217N |
| T218Q | T218H | T218N | A219Q | A219H | A219N | A220Q | A220H | A220N | V223Q |
| V223H | V223N | E224Q | E224H | E224N | T225Q | T225H | T225N | G226Q | G226H |
| G226N | V227Q | V227H | V227N | K228N | K228Q | I229Q | I229H | I229N | T230Q |
| T230H | T230N | V231Q | V231H | V231N | V232Q | V232H | V232N | A233Q | A233H |
| A233N | G234Q | G234H | G234N | E235Q | E235H | E235N | I238Q | I238H | I238N |
| E239Q | E239H | E239N | E240Q | E240H | E240N | T241Q | T241H | T241N | E242Q |
| E242H | E242N | T244Q | T244H | T244N | E245Q | E245H | E245N | K247N | K247Q |
| R248H | R248Q | V250Q | V250H | V250N | I251Q | I251H | I251N | R252H | R252Q |
| I253Q | I253H | I253N | I254Q | I254H | I254N | P255A | P255S | Y259H | Y259I |

TABLE 10-continued

List of human FIX variants for testing increased resistance to proteolysis

| | | | | | | | | | |
|---|---|---|---|---|---|---|---|---|---|
| A261Q | A261H | A261N | A262Q | A262H | A262N | I263Q | I263H | I263N | K265N |
| K265Q | Y266Q | Y266I | D269N | D269Q | I270Q | I270N | I270H | A271Q | A271H |
| A271N | L272I | L272V | L273I | L273V | E274Q | E274H | E274N | L275I | L275V |
| D276N | D276Q | E277Q | E277H | E277N | P278A | P278S | L279I | L279V | V280Q |
| V280H | V280N | L281I | L281V | S283Q | S283H | S283N | Y284H | Y284I | V285Q |
| V285H | V285N | T286Q | T286H | T286N | P287A | P287S | I288Q | I288H | I288N |
| I290Q | I290H | I290N | A291Q | A291H | A291N | D292Q | D292H | K293N | K293Q |
| E294Q | E294H | E294N | Y295H | Y295I | T296Q | T296H | T296N | I298Q | I298H |
| I298N | F299I | F299V | L300I | L300V | K301N | K301Q | F302I | F302V | G303Q |
| G303H | G303N | S304Q | S304H | S304N | G305Q | G305H | G305N | Y306H | Y306I |
| V307Q | V307H | V307N | S308Q | S308H | S308N | G309Q | G309H | G309N | W310S |
| W310H | G311Q | G311H | G311N | R312H | R312Q | V313Q | V313H | V313N | F314I |
| F314V | K316N | K316Q | G317Q | G317H | G317N | R318H | R318Q | S319Q | S319H |
| S319N | A320Q | A320H | A320N | L321I | L321V | V322Q | V322H | V322N | L323I |
| L323V | Y325H | Y325I | L326I | L326V | R327H | V328Q | V328H | V328N | V328N |
| P329A | P329S | L330I | L330V | V331Q | V331H | V331N | D332N | D332Q | R333H |
| R333Q | A334Q | A334H | A334N | T335Q | T335H | T335N | L337I | L337V | R338H |
| R338Q | S339Q | S339H | S339N | T340Q | T340H | T340N | K341N | K341Q | F342I |
| F342V | T343Q | T343H | T343N | I344Q | I344H | Y345H | Y345I | M348I |
| M348V | F349I | F349V | A351Q | A351H | A351N | G352Q | G352H | G352N | F353I |
| F353V | E355Q | E355H | E355N | G356Q | G356H | G356N | G357Q | G357H | G357N |
| R358H | R358Q | D359N | D359Q | S360Q | S360H | S360N | G363Q | G363H | G363N |
| D364N | D364Q | S365Q | S365H | S365N | G366Q | G366N | G367Q | G367H |
| G367N | P368A | P368S | V370Q | V370H | V370N | T371Q | T371H | T371N | E372Q |
| E372H | E372N | V373Q | V373H | V373N | E374Q | E374H | E374N | G375Q | G375H |
| G375N | T376Q | T376H | T376N | S377Q | S377H | S377N | F378I | F378V | L379I |
| L379V | T380Q | T380H | T380N | G381Q | G381H | G381N | I382Q | I382H | I382N |
| I383Q | I383H | I383N | S384Q | S384H | S384N | W385S | W385H | G386Q | G386H |
| G386N | E387Q | E387H | E387N | E388Q | E388H | E388N | A390Q | A390H | A390N |
| M391I | M391V | K392N | K392Q | G393Q | G393H | G393N | K394N | K394Q | Y395H |
| Y395I | G396Q | G396H | G396N | I397Q | I397H | I397N | Y398N | Y398I | T399Q |
| T399H | T399N | K400N | K400Q | V401Q | V401H | V401N | S402Q | S402H | S402N |
| R403H | R403Q | Y404H | Y404I | V405Q | V405H | V405N | W407S | W407H | I408Q |
| I408H | I408N | K409N | K409Q | E410Q | E410H | E410N | K411N | K411Q | T412Q |
| T412H | T412N | K413N | K413Q | L414I | L414V | T415Q | T415H | T415N | |

Example 2

Production of Native and Modified Human FIX Polypeptides (Proteins) in Mammalian Cells and Yield Determination Human fetal kidney 293 HEK EBNA fibroblast cells were grown in Dulbecco's Modified Eagle's Medium (DMEM) supplemented with 2 mM glutamine and 10% SVF. Cells were plated at $5 \times 10^5$ cells per well in 6-well plate for 2 days, washed two times with PBS, and then switched to serum free medium. Cells were transfected with 2 µg of DNA (FIX variants in pNaut-FIX plasmid) using transfection reagent according to the instructions of the manufacturer (Perfectin, GTS). Cell medium was replaced after 4 hours with serum free media containing 50 µg/ml of vitamin K and 1X-ITS (insulin, transferrin, selenium) mixture. Cell medium was collected 72 hours after transfection and stored at −80° C.

ASSERACHROM® IX: Ag ELISA (Diagnostica Stago, France) was used to determine concentration of FIX in supernatants from cell production according to the instructions of the manufacturer. Samples were diluted 20-fold using kit dilution reagent. Absorbance at 492 nm was measured using a spectrophotometer (Spectramax, Molecular Devices). Results were obtained by interpolation of the absorbance values from the calibration curve obtained from patients' plasma dilutions and plotted in log-log graph. FIX level at 100% corresponded approximately to 4 mg/l. Yields of FIX native and mutant proteins produced in 293 HEK cells are shown in Table 11. The data are the results from two productions.

TABLE 11

Yield of FIX native and mutant proteins

| Nemo Code # | Mutation | FIX (mg/L) |
|---|---|---|
| 1 | Native FIX | 9.2 |
| 2 | T163N | 14.1 |
| 3 | T163Q | 11.2 |
| 4 | T163H | 10.1 |
| 5 | I164N | 8.9 |
| 6 | I164Q | 13.3 |
| 7 | I164H | 14.9 |
| 8 | T163N/I164N | 10.6 |
| 9 | I168N | 11.9 |
| 10 | I168Q | 11.9 |
| 11 | I168H | 12.6 |
| 12 | T169N | 7.5 |
| 13 | T169Q | 9.1 |
| 14 | T169H | 9.7 |
| 15 | S171N | 11.3 |
| 16 | S171Q | 11.7 |
| 17 | S171H | 10.2 |
| 18 | T172N | 17.9 |
| 19 | T172Q | 12.6 |
| 20 | T172H | 16.3 |
| 21 | S174N | 14.3 |
| 22 | S174Q | 11.5 |
| 23 | S174H | 12.1 |
| 24 | I168N/T169N/S171N/T172N/S174N | 12.9 |
| 25 | T179N | 10.0 |
| 26 | T179Q | 13.3 |
| 27 | T179H | 8.3 |
| 28 | V181N | 9.8 |
| 29 | V181Q | 20.3 |
| 30 | V181H | 13.2 |
| 31 | V182N | 7.5 |
| 32 | V182Q | 7.6 |

TABLE 11-continued

Yield of FIX native and mutant proteins

| Nemo Code # | Mutation | FIX (mg/L) |
|---|---|---|
| 33 | V182H | 12.1 |
| 34 | G183N | 14.1 |
| 35 | G183Q | 15.4 |
| 36 | G183H | 11.6 |
| 37 | G184N | 7.6 |
| 38 | G184Q | 10.7 |
| 39 | G184H | 8.9 |
| 40 | T179N/V181N/V182N/G183N/G184N | 4.9 |
| 41 | A187N | 1.3 |
| 42 | A187Q | 3.0 |
| 43 | A187H | 1.6 |
| 44 | G190N | 1.1 |
| 45 | G190Q | 0.4 |
| 46 | G190H | 5.4 |
| 47 | A187N/G190N | 1.1 |
| 48 | V196N | 0.5 |
| 49 | V196Q | 0.1 |
| 50 | V196H | 0.1 |
| 51 | V197N | 0.6 |
| 52 | V197Q | 1.4 |
| 53 | V197H | 3.1 |
| 54 | V196N/V197N | 0.1 |
| 55 | R180H | 9.9 |
| 56 | R180Q | 8.1 |
| 57 | K188N | 10.5 |
| 58 | K188Q | 13.4 |
| 59 | K201N | 8.3 |
| 60 | K201Q | 6.7 |
| 61 | L165I | 7.0 |
| 62 | L165V | 11.3 |
| 63 | F175I | 7.0 |
| 64 | F175V | 9.3 |
| 65 | F178I | 10.3 |
| 66 | F178V | 8.7 |
| 67 | F192I | 2.9 |
| 68 | F192V | 1.7 |
| 69 | W194H | 0.1 |
| 70 | W194I | 0.1 |
| 71 | L198I | 6.5 |
| 72 | L198V | 9.8 |
| 73 | D166Q | 7.6 |
| 74 | D166N | 6.8 |
| 75 | D177Q | 8.4 |
| 76 | D177N | 7.7 |
| 77 | D186Q | 9.7 |
| 78 | D186N | 14.6 |
| 79 | D203Q | 4.5 |
| 80 | D203N | 1.0 |
| 81 | T140N | 12.9 |
| 82 | T140Q | 11.4 |
| 83 | T140H | 7.8 |
| 84 | T144N | 9.3 |
| 85 | T144Q | 1.8 |
| 86 | T144H | 9.3 |
| 87 | T140N/T144N | 6.3 |
| 88 | L165Q | 13.9 |
| 89 | L165H | 8.3 |
| 90 | F175I/F178I | 8.1 |
| 91 | F175H | 10.7 |
| 92 | F178H | 4.5 |
| 93 | F192I/W194I | <0.1 |
| 94 | F192H | 0.8 |
| 95 | L198Q | 0.1 |
| 96 | L198H | 1.5 |
| 97 | D152N/D154N | 7.2 |
| 98 | D152N | 11.8 |
| 99 | D152Q | 7.0 |
| 100 | D154N | 4.4 |
| 101 | D154Q | 6.7 |

Example 3

Determination of Specific Activity of Human FIX by Coagulation Assay

The collection of human FIX mutants was tested for coagulation activity. Coagulation activity (expressed as clotting time $T_{50}$) was determined as the concentration needed for formation of a fibrin clot. Clotting activity of native and mutant FIX molecules was measured by the one stage activated partial thromboplastin time (aPTT) clotting assay (Cephascreen, Diagnostica Stago, France) using FIX immunodepleted human plasma (Deficient IX, Diagnostica Stago, France).

Briefly, 20 μl of production supernatant containing 60 ng of native FIX or mutant FIX was diluted with 60 μl of immunodepleted plasma. 80 μl of Cephascreen reagent containing cephalin (platelet substitute) prepared from rabbit cerebral tissues and a polyphenolic activator in a buffered medium was added to diluted FIX samples and incubated at 37° C. for 15 minutes. 80 μl of pre-warmed $CaCl_2$ (0.025M, Diagnostica Stago, France) was added to mixture of FIX/Cephascreen reagent samples, and the time required for clot formation was immediately monitored using spectrophotometer (Spectramax, Molecular devices) at 350 nm. Serial dilution of normal human pooled plasma representing 100 to 120% of FIX activity (System control N, Diagnostica Stago, France) was used as the standard curve in order to validate linearity of clotting time detection. Clotting activity of FIX native and mutant proteins by clotting assay is shown in Tables 12a and 12b. The $T_{50}$ values are displayed in seconds and represent the time required to achieved 50% clotting. The data are the result from two assays done in duplicate. Tables 12a and 12b below depict two separate experiments measuring the coagulation activity of exemplary non-limiting modified FIX polypeptides and native FIX. Table 12c depicts the protease specificity groups as indicated for each mutant.

TABLE 12a

Clotting activity of FIX native and mutant proteins

| Nemo Code # | Mutation | Bioactivity Clotting Assay T50 (sec) |
|---|---|---|
| 1 | Native FIX | 116 |
| 2 | T163N | 111 |
| 3 | T163Q | 117 |
| 4 | T163H | 108 |
| 5 | I164N | 105 |
| 6 | I164Q | 113 |
| 7 | I164H | 118 |
| 8 | T163N/I164N | 108 |
| 9 | I168N | 112 |
| 10 | I168Q | 119 |
| 11 | I168H | 112 |
| 12 | T169N | 104 |
| 13 | T169Q | 104 |
| 14 | T169H | 111 |
| 15 | S171N | 116 |
| 16 | S171Q | 112 |
| 17 | S171H | 110 |
| 18 | T172N | 133 |
| 19 | T172Q | 111 |
| 20 | T172H | 111 |
| 21 | S174N | 113 |
| 22 | S174Q | 115 |
| 23 | S174H | 113 |
| 24 | I168N/T169N/S171N/T172N/S174N | 112 |
| 25 | T179N | 115 |

TABLE 12a-continued

Clotting activity of FIX native and mutant proteins

| Nemo Code # | Mutation | Bioactivity Clotting Assay T50 (sec) |
|---|---|---|
| 26 | T179Q | 112 |
| 27 | T179H | 110 |
| 28 | V181N | 178 |
| 29 | V181Q | 141 |
| 30 | V181H | 179 |
| 31 | V182N | 174 |
| 32 | V182Q | 156 |
| 33 | V182H | 176 |
| 34 | G183N | 146 |
| 35 | G183Q | 155 |
| 36 | G183H | 170 |
| 37 | G184N | 177 |
| 38 | G184Q | 178 |
| 39 | G184H | 179 |
| 40 | T179N/V181N/V182N/G183N/G184N | nd |
| 41 | A187N | 180 |
| 42 | A187Q | 169 |
| 43 | A187H | 201 |
| 44 | G190N | 148 |
| 45 | G190Q | 162 |
| 46 | G190H | 120 |
| 47 | A187N/G190N | 194 |
| 48 | V196N | 183 |
| 49 | V196Q | 176 |
| 50 | V196H | 183 |
| 51 | V197N | 161 |
| 52 | V197Q | 157 |
| 53 | V197H | 123 |
| 54 | V196N/V197N | 190 |
| 55 | R180H | 191 |
| 56 | R180Q | 186 |
| 57 | K188N | 124 |
| 58 | K188Q | 130 |
| 59 | K201N | 119 |
| 60 | K201Q | 118 |
| 61 | L165I | 109 |
| 62 | L165V | 120 |
| 63 | F175I | 116 |
| 64 | F175V | 118 |
| 65 | F178I | 140 |
| 66 | F178V | 122 |
| 67 | F192I | 134 |
| 68 | F192V | 145 |
| 69 | W194H | 183 |
| 70 | W194I | 168 |
| 71 | L198I | 124 |
| 72 | L198V | 168 |
| 73 | D166Q | 119 |
| 74 | D166N | 118 |
| 75 | D177Q | 118 |
| 76 | D177N | 182 |
| 77 | D186Q | 127 |
| 78 | D186N | 117 |
| 79 | D203Q | 109 |
| 80 | D203N | 113 |
| 81 | T140N | 118 |
| 82 | T140Q | 143 |
| 83 | T140H | 119 |
| 84 | T144N | 151 |
| 85 | T144Q | nd |
| 86 | T144H | 117 |
| 87 | T140N/T144N | 133 |
| 88 | L165Q | 117 |
| 89 | L165H | 118 |
| 90 | F175I/F178I | 155 |
| 91 | F175H | 153 |
| 92 | F178H | 127 |
| 93 | F192I/W194I | 175 |
| 94 | F192H | 154 |
| 95 | L198Q | 183 |
| 96 | L198H | 178 |
| 97 | D152N/D154N | 125 |
| 98 | D152N | 148 |
| 99 | D152Q | 126 |
| 100 | D154N | 119 |
| 101 | D154Q | 150 | nd = not determined

TABLE 12b

Clotting activity of FIX native and mutant proteins

| Nemo Code # | Mutation | Bioactivity Clotting Assay T50 (sec) |
|---|---|---|
| 1 | Native FIX | 114 |
| 2 | T163N | 113 |
| 3 | T163Q | 118 |
| 4 | T163H | 110 |
| 5 | I164N | 107 |
| 6 | I164Q | 114 |
| 7 | I164H | 115 |
| 8 | T163N/I164N | 110 |
| 9 | I168N | 111 |
| 10 | I168Q | 119 |
| 11 | I168H | 111 |
| 12 | T169N | 110 |
| 13 | T169Q | 108 |
| 14 | T169H | 111 |
| 15 | S171N | 116 |
| 16 | S171Q | 111 |
| 17 | S171H | 110 |
| 18 | T172N | 143 |
| 19 | T172Q | 112 |
| 20 | T172H | 113 |
| 21 | S174N | 113 |
| 22 | S174Q | 115 |
| 23 | S174H | 112 |
| 24 | I168N/T169N/S171N/T172N/S174N | 113 |
| 25 | T179N | 116 |
| 26 | T179Q | 114 |
| 27 | T179H | 115 |
| 28 | V181N | 200 |
| 29 | V181Q | 120 |
| 30 | V181H | 196 |
| 31 | V182N | 180 |
| 32 | V182Q | 165 |
| 33 | V182H | 180 |
| 34 | G183N | 150 |
| 35 | G183Q | 162 |
| 36 | G183H | 182 |
| 37 | G184N | 195 |
| 38 | G184Q | 187 |
| 39 | G184H | 192 |
| 40 | T179N/V181N/V182N/G183N/G184N | 169 |
| 41 | A187N | 200 |
| 42 | A187Q | 163 |
| 43 | A187H | 202 |
| 44 | G190N | 148 |
| 45 | G190Q | 158 |
| 46 | G190H | 123 |
| 47 | A187N/G190N | 201 |
| 48 | V196N | 191 |
| 49 | V196Q | 183 |
| 50 | V196H | 191 |
| 51 | V197N | 155 |
| 52 | V197Q | 148 |
| 53 | V197H | 130 |
| 54 | V196N/V197N | 203 |
| 55 | R180H | 202 |
| 56 | R180Q | 200 |

TABLE 12b-continued

Clotting activity of FIX native and mutant proteins

| Nemo Code # | Mutation | Bioactivity Clotting Assay T50 (sec) |
|---|---|---|
| 57 | K188N | 124 |
| 58 | K188Q | 130 |
| 59 | K201N | 121 |
| 60 | K201Q | 118 |
| 61 | L165I | 109 |
| 62 | L165V | 121 |
| 63 | F175I | 119 |
| 64 | F175V | 120 |
| 65 | F178I | 166 |
| 66 | F178V | 122 |
| 67 | F192I | 113 |
| 68 | F192V | 134 |
| 69 | W194H | 192 |
| 70 | W194I | 188 |
| 71 | L198I | 128 |
| 72 | L198V | 175 |
| 73 | D166Q | 118 |
| 74 | D166N | 116 |
| 75 | D177Q | 118 |
| 76 | D177N | 195 |
| 77 | D186Q | 125 |
| 78 | D186N | 116 |
| 79 | D203Q | 112 |
| 80 | D203N | 110 |
| 81 | T140N | 116 |
| 82 | T140Q | 124 |
| 83 | T140H | 117 |
| 84 | T144N | 132 |
| 85 | T144Q | 123 |
| 86 | T144H | 114 |
| 87 | T140N/T144N | 128 |
| 88 | L165Q | 117 |
| 89 | L165H | 119 |
| 90 | F175I/F178I | 147 |
| 91 | F175H | 131 |
| 92 | F178H | 122 |
| 93 | F192I/W194I | 193 |
| 94 | F192H | 154 |
| 95 | L198Q | 198 |
| 96 | L198H | 199 |
| 97 | D152N/D154N | 121 |
| 98 | D152N | 131 |
| 99 | D152Q | 121 |
| 100 | D154N | 112 |
| 101 | D154Q | 134 |
| 102 | D152N | 123 |
| 103 | D152Q | 121 |
| 104 | D154N | 120 |
| 105 | D154Q | 118 |

TABLE 12c

Protease specificity groups for FIX mutant proteins

| Nemo Code # | Mutation | Specificity Group |
|---|---|---|
| 1 | Native FIX | — |
| 2 | T163N | E |
| 3 | T163Q | E |
| 4 | T163H | E |
| 5 | I164N | E |
| 6 | I164Q | E |
| 7 | I164H | E |
| 8 | T163N/I164N | E |
| 9 | I168N | E |
| 10 | I168Q | E |
| 11 | I168H | E |
| 12 | T169N | E |
| 13 | T169Q | E |
| 14 | T169H | E |
| 15 | S171N | E |
| 16 | S171Q | E |
| 17 | S171H | E |
| 18 | T172N | E |
| 19 | T172Q | E |
| 20 | T172H | E |
| 21 | S174N | E |
| 22 | S174Q | E |
| 23 | S174H | E |
| 24 | I168N/T169N/S171N/T172N/S174N | E |
| 25 | T179N | E |
| 26 | T179Q | E |
| 27 | T179H | E |
| 28 | V181N | E |
| 29 | V181Q | E |
| 30 | V181H | E |
| 31 | V182N | E |
| 32 | V182Q | E |
| 33 | V182H | E |
| 34 | G183N | E |
| 35 | G183Q | E |
| 36 | G183H | E |
| 37 | G184N | E |
| 38 | G184Q | E |
| 39 | G184H | E |
| 40 | T179N/V181N/V182N/G183N/G184N | E |
| 41 | A187N | E |
| 42 | A187Q | E |
| 43 | A187H | E |
| 44 | G190N | E |
| 45 | G190Q | E |
| 46 | G190H | E |
| 47 | A187N/G190N | E |
| 48 | V196N | E |
| 49 | V196Q | E |
| 50 | V196H | E |
| | | E |
| 51 | V197N | E |
| 52 | V197Q | E |
| 53 | V197H | E |
| 54 | V196N/V197N | E |
| 55 | R180H | T |
| 56 | R180Q | T |
| 57 | K188N | T |
| 58 | K188Q | T |
| 59 | K201N | T |
| 60 | K201Q | T |
| 61 | L165I | CT |
| 62 | L165V | CT |
| 63 | F175I | CT |
| 64 | F175V | CT |
| 65 | F178I | CT |
| 66 | F178V | CT |
| 67 | F192I | CT |
| 68 | F192V | CT |
| 69 | W194H | CT |
| 70 | W194I | CT |
| 71 | L198I | CT |
| 72 | L198V | CT |
| 73 | D166Q | EAsp |
| 74 | D166N | EAsp |
| 75 | D177Q | EAsp |
| 76 | D177N | EAsp |
| 77 | D186Q | EAsp |
| 78 | D186N | EAsp |
| 79 | D203Q | EAsp |
| 80 | D203N | EAsp |
| 81 | T140N | CT |
| 82 | T140Q | CT |
| 83 | T140H | CT |
| 84 | T144N | CT |
| 85 | T144Q | CT |
| 86 | T144H | CT |
| 87 | T140N/T144N | CT |

TABLE 12c-continued

Protease specificity groups for FIX mutant proteins

| Nemo Code # | Mutation | Specificity Group |
|---|---|---|
| 88 | L165Q | CT |
| 89 | L165H | CT |
| 90 | F175I/F178I | CT |
| 91 | F175H | CT |
| 92 | F178H | CT |
| 93 | F192I/W194I | CT |
| 94 | F192H | CT |
| 95 | L198Q | CT |
| 96 | L198H | CT |
| 97 | D152N/D154N | EAsp |
| 98 | D152N | EAsp |
| 99 | D152Q | EAsp |
| 100 | D154N | EAsp |
| 101 | D154Q | EAsp |
| 102 | D152N | EAsp |
| 103 | D152Q | EAsp |
| 104 | D154N | EAsp |
| 105 | D154Q | EAsp |

E = elastase;
T = trypsin;
CT = chymotrypsin;
EAsp = Endoproteinase AspN

Example 4

Resistance to Proteolysis

The collection of human FIX mutants was tested for their resistance to proteolysis as measured by retention of coagulation activity following treatment with proteases. Equal amounts of FIX native or mutant proteins (60 ng per assays) were treated with selected proteases (1.5% w/w trypsin, chymotrypsin, endoproteinase AspN, and endoproteinase GluC; and 6% w/w elastase). Aliquots of the samples were taken at different time points between 0.083 and 8 hrs and the proteolysis reaction was stopped by adding antiprotease cocktail (Roche Cat No. 11836170001). Samples were conserved at −20° C. until determination of clotting time could be performed. Clotting activity of the treated samples was assayed as described in Example 3 to determine residual clotting activity at each time point. Resistance to proteases for exemplary non-limiting modified FIX polypeptides is displayed in Table 13 as either no change in (N) or increased (+) resistance to proteases as compared to the residual coagulation activity of native FIX under the same protease treatment conditions.

The data are not meant to be representative of all proteases, but are exemplary data showing the resistance to proteolysis to an exemplary protease cocktail containing the proteases as described above. Thus, the data are not comprehensive and are not meant to be indicative that other FIX polypeptides do not exhibit protease resistance.

TABLE 13

Resistance to proteolysis of FIX native and mutant proteins

| Nemo Code # | Mutation | Resistance to proteases |
|---|---|---|
| 1 | Native FIX | − |
| 2 | T163N | N |
| 3 | T163Q | N |
| 4 | T163H | + |
| 5 | I164N | N |
| 6 | I164Q | + |
| 7 | I164H | + |
| 8 | T163N/I164N | + |
| 9 | I168N | N |
| 10 | I168Q | + |
| 11 | I168H | + |
| 12 | T169N | N |
| 13 | T169Q | N |
| 14 | T169H | + |
| 15 | S171N | + |
| 16 | S171Q | + |
| 17 | S171H | N |
| 18 | T172N | N |
| 19 | T172Q | + |
| 20 | T172H | N |
| 21 | S174N | N |
| 22 | S174Q | + |
| 23 | S174H | + |
| 24 | I168N/T169N/S171N/T172N/S174N | N |
| 25 | T179N | + |
| 26 | T179Q | + |
| 27 | T179H | + |
| 28 | V181N | N |
| 29 | V181Q | + |
| 30 | V181H | N |
| 31 | V182N | + |
| 32 | V182Q | N |
| 33 | V182H | N |
| 34 | G183N | N |
| 35 | G183Q | N |
| 36 | G183H | N |
| 37 | G184N | + |
| 38 | G184Q | N |
| 39 | G184H | N |
| 40 | T179N/V181N/V182N/G183N/G184N | N |
| 41 | A187N | N |
| 42 | A187Q | + |
| 43 | A187H | N |
| 44 | G190N | N |
| 45 | G190Q | N |
| 46 | G190H | N |
| 47 | A187N/G190N | N |
| 48 | V196N | N |
| 49 | V196Q | N |
| 50 | V196H | N |
| 51 | V197N | N |
| 52 | V197Q | N |
| 53 | V197H | + |
| 54 | V196N/V197N | N |
| 55 | R180H | N |
| 56 | R180Q | N |
| 57 | K188N | N |
| 58 | K188Q | N |
| 59 | K201N | N |
| 60 | K201Q | N |
| 61 | L165I | N |
| 62 | L165V | N |
| 63 | F175I | N |
| 64 | F175V | N |
| 65 | F178I | N |
| 66 | F178V | N |
| 67 | F192I | + |
| 68 | F192V | N |
| 69 | W194H | N |
| 70 | W194I | N |
| 71 | L198I | + |
| 72 | L198V | + |
| 73 | D166Q | + |
| 74 | D166N | + |
| 75 | D177Q | + |
| 76 | D177N | + |
| 77 | D186Q | + |
| 78 | D186N | + |
| 79 | D203Q | + |

TABLE 13-continued

Resistance to proteolysis of FIX native and mutant proteins

| Nemo Code # | Mutation | Resistance to proteases |
|---|---|---|
| 80 | D203N | + |
| 81 | T140N | N |
| 82 | T140Q | N |
| 83 | T140H | N |
| 84 | T144N | N |
| 85 | T144Q | N |
| 86 | T144H | N |
| 87 | T140N/T144N | + |
| 88 | L165Q | N |
| 89 | L165H | N |
| 90 | F175I/F178I | + |
| 91 | F175H | + |
| 92 | F178H | N |
| 93 | F192I/W194I | N |
| 94 | F192H | N |
| 95 | L198Q | N |
| 96 | L198H | N |
| 97 | D152N/D154N | + |
| 98 | D152N | N |
| 99 | D152Q | + |
| 100 | D154N | + |
| 101 | D154Q | N |

N = no change;
+ = Increased resistance to proteolysis

In one exemplary assay, native FIX had a large increase in its $T_{50}$ clotting time from about 140 seconds to about 200 seconds after only 0.5 hours of incubation with proteases, whereas exemplary modified FIX polypeptides with increased resistance to proteases, such as D203Q, had an increase in $T_{50}$ clotting time from about 150 seconds to about 160 seconds after 0.5 hours of incubation with proteases. After 2 hours of incubation with proteases the $T_{50}$ clotting time for D203Q only increased to about 173 seconds, and after 3 hours, 190 seconds. Similarly, exemplary modified FIX polypeptides D154N, and D152N/D154N exhibited $T_{50}$ clotting times of 160 seconds and 170 seconds, respectively, after 0.5 hours of incubation with proteases, and 170 seconds and 178 seconds, after 2 hours of incubation with proteases. The results demonstrate that exemplary modified FIX polypeptides are more resistant to protease treatment than native FIX. Thus, the modified FIX polypeptides indicated to have an "increase" protease resistance as compared to native FIX have a greater half-d life and are more stable than wild-type FIX polypeptides following incubation with one or more proteases.

Example 5

SuperLEAD Clotting Activity and Resistance to Proteolysis

Based on the data obtained above for protease resistance of FIX LEAD polypeptides, selected FIX SuperLEAD polypeptides were generated and tested for their clotting activity and resistance to proteolysis as measured by retention of coagulation activity following treatment with proteases. A schematic representation of the combinations used to generate triple SuperLEADs is shown in Table 14.

TABLE 14

Generation of SuperLEAD Combinations

NEMO code

2nd mutation (Endoproteinase AspN) →

| 67 | 73 | 74 | 77 | 78 | 79 | 80 | 97 | 100 |
|---|---|---|---|---|---|---|---|---|
| 4 | 141 | 142 | 143 | 144 | 145 | 146 | 147 | 148 |
| 6 | 149 | 150 | 151 | 152 | 153 | 154 | 155 | 156 |
| 8 | 157 | 158 | 159 | 160 | 161 | 162 | 163 | 164 |
| 14 | 165 | 166 | 167 | 168 | 169 | 170 | 171 | 172 |
| 16 | 173 | 174 | 175 | 176 | 177 | 178 | 179 | 180 |
| 22 | 181 | 182 | 183 | 184 | 185 | 186 | 187 | 188 |
| 23 | 189 | 190 | 191 | 192 | 193 | 194 | 195 | 196 |
| 26 | 197 | 198 | 199 | 200 | 201 | 202 | 203 | 204 |
| 27 | 205 | 206 | 207 | 208 | 209 | 210 | 211 | 212 |

↑ 3rd mutation (Elastase)

Clotting activity of exemplary non-limiting FIX SuperLEAD polypeptides was assayed as described above in Example 3, and the data is shown in Table 14b. The $T_{50}$ values displayed in seconds and represent the time required to achieved 50% clotting.

TABLE 14b

| Clotting activity of FIX SuperLEAD mutant proteins | | |
|---|---|---|
| Nemo Code # | Mutation | Bioactivity Clotting Assay $T_{50}$ (sec) |
| 107 | T163H/F192I | 99 |
| 108 | I164Q/F192I | 101 |
| 109 | T163N/I164N/F192I | 106 |
| 110 | T169H/F192I | 94 |
| 111 | S171Q/F192I | 105 |
| 112 | S174Q/F192I | 99 |
| 113 | S174H/F192I | 101 |
| 114 | T179Q/F192I | 94 |
| 115 | T179H/F192I | 101 |
| 116 | D166Q/F192I | 93 |
| 117 | D166N/F192I | 104 |
| 118 | D186Q/F192I | 113 |
| 119 | D186N/F192I | 111 |
| 120 | F192I/D203Q | 90 |
| 121 | F192I/D203N | 181 |
| 122 | T148A/D152N/D154N/F192I | 90 |
| 123 | T148A/D154N/F192I | 105 |
| 141 | T163H/D166Q/F192I | 97 |
| 142 | T163H/D166N/F192I | 89 |
| 143 | T163H/D186Q/F192I | 123 |
| 144 | T163H/D186N/F192I | 103 |
| 145 | T163H/F192I/D203Q | 90 |
| 146 | T163H/F192I/D203N | 89 |
| 147 | T148A/D152N/D154N/T163H/F192I | 101 |
| 148 | T148A/D154N/T163H/F192I | 92 |
| 149 | I164Q/D166Q/F192I | ND |
| 150 | I164Q/D166N/F192I | ND |
| 151 | I164Q/D186Q/F192I | 109 |
| 152 | I164Q/D186N/F192I | 101 |
| 153 | I164Q/F192I/D203Q | 96 |
| 154 | I164Q/F192I/D203N | 87 |
| 155 | T148A/D152N/D154N/I164Q/F192I | 97 |
| 156 | T148A/D154N/I164Q/F192I | 95 |
| 157 | T163N/I164N/D166Q/F192I | 103 |
| 158 | T163N/I164N/D166N/F192I | 100 |
| 159 | T163N/I164N/D186Q/F192I | 128 |
| 160 | T163N/I164N/D186N/F192I | 102 |
| 161 | T163N/I164N/F192I/D203Q | 101 |
| 162 | T163N/I164N/F192I/D203N | 95 |
| 163 | T148A/D152N/D154N/T163N/I164N/F192I | 100 |
| 164 | T148A/D154N/T163N/I164N/F192I | 97 |

TABLE 14b-continued

Clotting activity of FIX SuperLEAD mutant proteins

| Nemo Code # | Mutation | Bioactivity Clotting Assay $T_{50}$ (sec) |
|---|---|---|
| 165 | D166Q/T169H/F192I | 99 |
| 166 | D166N/T169H/F192I | 96 |
| 167 | T169H/D186Q/F192I | 114 |
| 168 | T169H/D186N/F192I | 100 |
| 169 | T169H/F192I/D203Q | 86 |
| 170 | T169H/F192I/D203N | 97 |
| 171 | T148A/D152N/D154N/T169H/F192I | 95 |
| 172 | T148A/D154N/T169H/F192I | 87 |
| 173 | D166Q/S171Q/F192I | 104 |
| 174 | D166N/S171Q/F192I | 97 |
| 175 | S171Q/D186Q/F192I | 126 |
| 176 | S171Q/D186N/F192I | 116 |
| 177 | S171Q/F192I/D203Q | 90 |
| 178 | S171Q/F192I/D203N | 90 |
| 179 | T148A/D152N/D154N/S171Q/F192I | ND |
| 180 | T148A/D154N/S171Q/F192I | 104 |
| 181 | D166Q/S174Q/F192I | 93 |
| 182 | D166N/S174Q/F192I | 95 |
| 183 | S174Q/D186Q/F192I | 129 |
| 184 | S174Q/D186N/F192I | 109 |
| 185 | S174Q/F192I/D203Q | 95 |
| 186 | S174Q/F192I/D203N | 96 |
| 187 | T148A/D152N/D154N/S174Q/F192I | 97 |
| 188 | T148A/D154N/S174Q/F192I | 91 |
| 189 | D166Q/S174H/F192I | 93 |
| 190 | D166N/S174H/F192I | 102 |
| 191 | S174H/D186Q/F192I | 110 |
| 192 | S174H/D186N/F192I | 102 |
| 193 | S174H/F192I/D203Q | 98 |
| 194 | S174H/F192I/D203N | 99 |
| 195 | T148A/D152N/D154N/S174H/F192I | 98 |
| 196 | T148A/D154N/S174H/F192I | 102 |
| 197 | D166Q/T179Q/F192I | 100 |
| 198 | D166N/T179Q/F192I | 89 |
| 199 | T179Q/D186Q/F192I | 120 |
| 200 | T179Q/D186N/F192I | 107 |
| 201 | T179Q/F192I/D203Q | 92 |
| 202 | T179Q/F192I/D203N | 94 |
| 203 | T148A/D152N/D154N/T179Q/F192I | 106 |
| 204 | T148A/D154N/T179Q/F192I | 98 |
| 205 | D166Q/T179H/F192I | 103 |
| 206 | D166N/T179H/F192I | 97 |
| 207 | T179H/D186Q/F192I | 130 |
| 208 | T179H/D186N/F192I | 113 |
| 209 | T179H/F192I/D203Q | 94 |
| 210 | T179H/F192I/D203N | 96 |
| 211 | T148A/D152N/D154N/T179H/F192I | 103 |
| 212 | T148A/D154N/T179H/F192I | 102 |

Resistance to proteolysis of FIX SuperLEADs was assayed as described above in Example 4. For testing of FIX SuperLEADs, the concentration of selected proteases (trypsin, chymotrypsin, endoproteinase AspN, endoproteinase GluC, and elastase) was increased to 6% w/w. Resistance to proteases for exemplary non-limiting modified FIX SuperLEAD polypeptides is displayed in Table 15a. The data is expressed as relative resistance to proteases among the samples tested: (+), (++), or (+++), with (+++) indicating the highest resistance to proteases.

TABLE 15a

Resistance to proteolysis of FIX SuperLEAD mutant proteins

| Nemo Code # | Mutation | Resistance to proteases |
|---|---|---|
| 107 | T163H/F192I | (+) |
| 108 | I164Q/F192I | (+) |
| 109 | T163N/I164N/F192I | (+) |
| 110 | T169H/F192I | (+) |
| 111 | S171Q/F192I | (+) |
| 112 | S174Q/F192I | (+) |
| 113 | S174H/F192I | (+) |
| 114 | T179Q/F192I | (+) |
| 115 | T179H/F192I | (+) |
| 116 | D166Q/F192I | (+) |
| 117 | D166N/F192I | (+) |
| 118 | D186Q/F192I | (++) |
| 119 | D186N/F192I | (+) |
| 120 | F192I/D203Q | (+) |
| 121 | F192I/D203N | (+) |
| 122 | T148A/D152N/D154N/F192I | (++) |
| 123 | T148A/D154N/F192I | (+) |
| 141 | T163H/D166Q/F192I | (++) |
| 142 | T163H/D166N/F192I | (+) |
| 143 | T163H/D186Q/F192I | (+) |
| 144 | T163H/D186N/F192I | (+) |
| 145 | T163H/F192I/D203Q | (++) |
| 146 | T163H/F192I/D203N | (+) |
| 147 | T148A/D152N/D154N/T163H/F192I | (+) |
| 148 | T148A/D154N/T163H/F192I | (++) |
| 149 | I164Q/D166Q/F192I | (+) |
| 150 | I164Q/D166N/F192I | (+) |
| 151 | I164Q/D186Q/F192I | (+) |
| 152 | I164Q/D186N/F192I | (+) |
| 153 | I164Q/F192I/D203Q | (++) |
| 154 | I164Q/F192I/D203N | (++) |
| 155 | T148A/D152N/D154N/I164Q/F192I | (+) |
| 156 | T148A/D154N/I164Q/F192I | (+) |
| 157 | T163N/I164N/D166Q/F192I | (+) |
| 158 | T163N/I164N/D166N/F192I | (+) |
| 159 | T163N/I164N/D186Q/F192I | (+) |
| 160 | T163N/I164N/D186N/F192I | (+) |
| 161 | T163N/I164N/F192I/D203Q | (+) |
| 162 | T163N/I164N/F192I/D203N | (+) |
| 163 | T148A/D152N/D154N/T163N/I164N/F192I | (+) |
| 164 | T148A/D154N/T163N/I164N/F192I | (++) |
| 165 | D166Q/T169H/F192I | (+) |
| 166 | D166N/T169H/F192I | (+) |
| 167 | T169H/D186Q/F192I | (+) |
| 168 | T169H/D186N/F192I | (+) |
| 169 | T169H/F192I/D203Q | (+) |
| 170 | T169H/F192I/D203N | (++) |
| 171 | T148A/D152N/D154N/T169H/F192I | (+) |
| 172 | T148A/D154N/T169H/F192I | (+) |
| 173 | D166Q/S171Q/F192I | (+) |
| 174 | D166N/S171Q/F192I | (+) |
| 175 | S171Q/D186Q/F192I | (+) |
| 176 | S171Q/D186N/F192I | (+) |
| 177 | S171Q/F192I/D203Q | (+) |
| 178 | S171Q/F192I/D203N | (+) |
| 179 | T148A/D152N/D154N/S171Q/F192I | (+) |
| 180 | T148A/D154N/S171Q/F192I | (+) |
| 181 | D166Q/S174Q/F192I | (+) |
| 182 | D166N/S174Q/F192I | (+) |
| 183 | S174Q/D186Q/F192I | (+) |
| 184 | S174Q/D186N/F192I | (+) |
| 185 | S174Q/F192I/D203Q | (+++) |
| 186 | S174Q/F192I/D203N | (+) |

TABLE 15a-continued

Resistance to proteolysis of FIX SuperLEAD mutant proteins

| Nemo Code # | Mutation | Resistance to proteases |
|---|---|---|
| 187 | T148A/D152N/D154N/S174Q/F192I | (+) |
| 188 | T148A/D154N/S174Q/F192I | (+) |
| 189 | D166Q/S174H/F192I | (+) |
| 190 | D166N/S174H/F192I | (+) |
| 191 | S174H/D186Q/F192I | (+) |
| 192 | S174H/D186N/F192I | (+++) |
| 193 | S174H/F192I/D203Q | (+) |
| 194 | S174H/F192I/D203N | (+) |
| 195 | T148A/D152N/D154N/S174H/F192I | (+) |
| 196 | T148A/D154N/S174H/F192I | (+) |
| 197 | D166Q/T179Q/F192I | (+) |
| 198 | D166N/T179Q/F192I | (+) |
| 199 | T179Q/D186Q/F192I | (+) |
| 200 | T179Q/D186N/F192I | (+) |
| 201 | T179Q/F192I/D203Q | (+++) |
| 202 | T179Q/F192I/D203N | (+) |
| 203 | T148A/D152N/D154N/T179Q/F192I | (+) |
| 204 | T148A/D154N/T179Q/F192I | (+) |
| 205 | D166Q/T179H/F192I | (+) |
| 206 | D166N/T179H/F192I | (+) |
| 207 | T179H/D186Q/F192I | (+) |
| 208 | T179H/D186N/F192I | (+) |
| 209 | T179H/F192I/D203Q | (+) |
| 210 | T179H/F192I/D203N | (+) |
| 211 | T148A/D152N/D154N/T179H/F192I | (+) |
| 212 | T148A/D154N/T179H/F192I | (+) |

All variants tested exhibited increased protease resistance relative to the native FIX polypeptide. Several FIX SuperLEAD polypeptides exhibited particularly high resistance to proteases including D186Q/F192I, T148A/D152N/D154N/F192I, T163H/D166Q/F192I, T163H/F192I/D203Q, T148A/D154N/T163H/F192I, I164Q/F192I/D203Q, I164Q/F192I/D203N, T148A/D154N/T163N/I164N/F192I, T169H/F192I/D203N, S174Q/F192I/D203Q, S174H/D186N/F192I, and T179Q/F192I/D203Q.

In a separate experiment, protease resistance of selected SuperLEADs was assayed by the same methods as described above. In this experiment, the data for resistance to proteases was compared in terms of $t_{1/2}$ clotting time fold increase at 50% of $T_0$ compared to native Factor IX. Data for this analysis is shown in Table 15b

TABLE 15b

Resistance to proteolysis of FIX SuperLEAD mutant proteins

| Nemo code | mutations | protease specificity of leads | clotting time (seconds) | protease resistance (50% $t_{1/2}$ clotting fold-increase versus native) |
|---|---|---|---|---|
| 161 | T163N/I164N/F192I/D203Q | EndAsp + CT + E | 101 | 4.2 |
| 194 | S174H/F192I/D203N | EndAsp + CT + E | 99 | 4.2 |
| 195 | T148A/D152N/D154N/S174H/F192I | EndAsp + CT + E | 98 | 4 |
| 145 | T163H/F192I/D203Q | EndAsp + CT + E | 90 | 3.3 |
| 107 | F192I-T163H | EndAsp + CT | 99 | 3.2 |
| 120 | F192I-D203Q | EndAsp + CT | 90 | 3.2 |
| 147 | T148A/D152N/D154N/T163H/F192I | EndAsp + CT + E | 101 | 3 |
| 170 | T169H/F192I/D203N | EndAsp + CT + E | 97 | 2.8 |
| 177 | S171Q/F192I/D203Q | EndAsp + CT + E | 90 | 2.8 |
| 203 | T148A/D152N/D154N/T179Q/F192I | EndAsp + CT + E | 106 | 2.8 |
| 153 | I164Q/F192I/D203Q | EndAsp + CT + E | 96 | 2.7 |
| 196 | T148A/D154N/S174H/F192I | EndAsp + CT + E | 102 | 2.7 |
| 157 | T163N/I164N/D166Q/F192I | EndAsp + CT + E | 103 | 2.5 |
| 180 | T148A/D154N/S171Q/F192I | EndAsp + CT + E | 104 | 2.5 |
| 193 | S174H/F192I/D203Q | EndAsp + CT + E | 98 | 2.5 |
| 204 | T148A/D154N/T179Q/F192I | EndAsp + CT + E | 98 | 2.5 |
| 146 | T163H/F192I/D203N | EndAsp + CT + E | 89 | 2.3 |
| 169 | T169H/F192I/D203Q | EndAsp + CT + E | 86 | 2.3 |
| 179 | T148A/D152N/D154N/S171Q/F192I | EndAsp + CT + E | 97 | 2.3 |
| 192 | S174H/D186N/F192I | EndAsp + CT + E | 102 | 2.3 |
| 172 | T148A/D154N/T169H/F192I | EndAsp + CT + E | 87 | 2.2 |
| 173 | D166Q/S171Q/F192I | EndAsp + CT + E | 104 | 2.2 |
| 202 | T179Q/F192I/D203N | EndAsp + CT + E | 94 | 2.2 |
| 185 | S174Q/F192I/D203Q | EndAsp + CT + E | 95 | 2 |
| 187 | T148A/D152N/D154N/S174Q/F192I | EndAsp + CT + E | 97 | 1.8 |
| 190 | D166N/S174H/F192I | EndAsp + CT + E | 102 | 1.8 |
| 119 | F192I-D186N | EndAsp + CT | 111 | 1.7 |
| 205 | D166Q/T179H/F192I | EndAsp + CT + E | 103 | 1.7 |
| 148 | T148A/D154N/T163H/F192I | EndAsp + CT + E | 92 | 1.5 |
| 175 | S171Q/D186Q/F192I | EndAsp + CT + E | 126 | 1.5 |
| 155 | T148A/D152N/D154N/I164Q/F192I | EndAsp + CT + E | 97 | 1.3 |
| native FIX | | | 114 | 1 |

All variants tested exhibited increased protease resistance relative to the native FIX polypeptide. Exemplary FIX SuperLEAD polypeptides that exhibited particularly high resistance to proteases in this analysis included T163N/I164N/F192I/D203Q, S174H/F192I/D203N, T148A/D152N/D154N/S174H/F192I, T163H/F192I/D203Q, T163H/F192I, F192I/D203Q, T148A/D152N/D154N/T163H/F192I, T169H/F192I/D203N, S171Q/F192I/D203Q, and T148A/D152N/D154N/T179Q/F192I.

The data above for the protease resistance are exemplary showing the resistance to proteolysis to an exemplary protease cocktail containing the proteases as described above. Thus, the data are not comprehensive and are not meant to be indicative that other FIX polypeptides do not exhibit protease resistance.

Example 6

SuperLEAD Clotting Activity and Resistance to Proteolysis Using an Alternative FIX Polypeptide Background As mentioned in Example 1, the starting FIX polypeptide on which the FIX variants were generated is shown in SEQ ID NO: 1035. This sequence differs from another wild-type FIX polypeptide shown in SEQ ID NO: 2 at five positions: K39T, L40E, I43K, S44Q and S46V. These changes, however, do not affect the clotting activity of the FIX polypeptide. In order to compare the activity of the FIX variants between the two polypeptide backgrounds, site-directed mutagenesis was performed to convert the SuperLEAD variants to the alternative FIX background (BFIX-T148). The mutants that were generated are shown in Table 16.

TABLE 16

FIX SuperLEAD Variants Produced on BFIX-T148 Background

| NFIX code | BFIX-T148 code | mutations |
|---|---|---|
| 161 | 249 | T163N/I164N/F192I/D203Q |
| 194 | 250 | S174H/F192I/D203N |
| 195 | 251 | T148A/D152N/D154N/S174H/F192I |
| 145 | 252 | T163H/F192I/D203Q |
| 107 | 253 | T163H/F192I |
| 120 | 254 | F192I/D203Q |
| 147 | 255 | T148A/D152N/D154N/T163H/F192I |
| 170 | 256 | T169H/F192I/D203N |

TABLE 16-continued

FIX SuperLEAD Variants Produced on BFIX-T148 Background

| NFIX code | BFIX-T148 code | mutations |
|---|---|---|
| 177 | 257 | S171Q/F192I/D203Q |
| 203 | 258 | T148A/D152N/D154N/T179Q/F192I |
| 153 | 259 | I164Q/F192I/D203Q |
| 196 | 260 | T148A/D154N/S174H/F192I |
| 157 | 261 | T163N/I164N/D166Q/F192I |
| 180 | 262 | T148A/D154N/S171Q/F192I |
| 193 | 263 | S174H/F192I/D203Q |
| 204 | 264 | T148A/D154N/T179Q/F192I |
| 146 | 265 | T163H/F192I/D203N |
| 169 | 266 | T169H/F192I/D203Q |
| 179 | 267 | T148A/D152N/D154N/S171Q/F192I |
| 192 | 268 | S174H/D186N/F192I |
| 172 | 269 | T148A/D154N/T169H/F192I |
| 173 | 270 | D166Q/S171Q/F192I |
| 202 | 271 | T179Q/F192I/D203N |
| 185 | 272 | S174Q/F192I/D203Q |
| 187 | 273 | T148A/D152N/D154N/S174Q/F192I |
| 190 | 274 | D166N/S174H/F192I |
| 119 | 275 | D186N/F192I |
| 205 | 276 | D166Q/T179H/F192I |
| 148 | 277 | T148A/D154N/T163H/F192I |
| 175 | 278 | S171Q/D186Q/F192I |
| 155 | 279 | T148A/D152N/D154N/I164Q/F192I |

Human fetal kidney 293 HEK EBNA fibroblast cell line was grown in Dulbecco's modified eagle medium supplemented with 2 mM of glutamine and 10% of fetal bovine serum (FBS). Cells were plated at $5 \times 10^5$ cells per well in 6-well plates for 2 days, washed twice with PBS and then placed in serum-free medium. Cells were transfected with 2 μg of DNA using transfection reagent (PEI, NaCl). The cell medium was replaced after 4 hours by serum-free medium containing 50 μg/mL of K vitamin and IX-ITS (Insulin, Transferrin, Selenium) mixture. The cell medium was collected 72 h after transfection and stored at −80° C.

Asserachrom® IX:Ag Elisa kit (Diagnostica Stago, France) was used to determine the concentration of the 31 selected mutant cell productions according to the instructions of the manufacturer. Samples were diluted 20-fold using the dilution reagent. Absorbance at 492 nm was measured using a spectrophotometer (Spectramax, Molecular Devices). Results were obtained by interpolation of the absorbance values from the calibration curve obtained from patients' plasma dilutions and plotted in a log-log graph. Factor IX level at 100% corresponds approximately to 4 mg/L. Data are presented in Table 17.

TABLE 17

Yields for BFIX T148 Super LEAD variants.

| Rank | mutant number in BFIX-T148 matrix | $1^{st}$ Production concentration (mg/l) | $2^{nd}$ Production concentration (mg/l) | $3^{rd}$ Production concentration (mg/l) | MEAN (3 PRODS) concentration (mg/l) |
|---|---|---|---|---|---|
| 1 | 249 | 7.2 | 9.7 | 32.7 | 16.5 |
| 2 | 250 | 4.3 | 13.0 | 22.7 | 13.3 |
| 3 | 251 | 6.3 | 9.5 | 14.9 | 10.2 |
| 4 | 252 | 10.9 | 10.4 | 5.3 | 8.9 |
| 5 | 253 | 15.6 | 12.1 | 4.0 | 10.6 |
| 6 | 254 | 13.3 | 11.3 | 8.1 | 10.9 |
| 7 | 255 | 6.4 | 4.8 | 22.0 | 11.1 |
| 8 | 256 | 6.2 | 9.6 | 21.3 | 12.3 |
| 9 | 257 | nd | nd | 7.8 | 7.8* |

TABLE 17-continued

Yields for BFIX T148 Super LEAD variants.

| Rank | mutant number in BFIX-T148 matrix | 1st Production concentration (mg/l) | 2nd Production concentration (mg/l) | 3rd Production concentration (mg/l) | MEAN (3 PRODS) concentration (mg/l) |
|---|---|---|---|---|---|
| 10 | 258 | 5.0 | 10.8 | 22.6 | 12.8 |
| 11 | 259 | nd | 17.3 | 10.4 | 13.9 |
| 12 | 260 | 6.7 | 8.5 | 22.4 | 12.5 |
| 13 | 261 | 8.9 | 16.1 | 24.4 | 16.5 |
| 14 | 262 | nd | nd | 11.7 | 11.7* |
| 15 | 263 | 5.5 | 10.4 | 23.9 | 13.3 |
| 16 | 264 | 9.6 | 6.6 | 19.5 | 11.9 |
| 17 | 265 | nd | 15.4 | 18.0 | 16.7 |
| 18 | 266 | 5.5 | 9.1 | 18.5 | 11.0 |
| 19 | 267 | 9.5 | 9.7 | 7.6 | 8.9 |
| 20 | 268 | nd | nd | 16.1 | 16.1* |
| 21 | 269 | 5.1 | 8.7 | 14.9 | 9.6 |
| 22 | 270 | 4.9 | 10.9 | 13.9 | 9.9 |
| 23 | 271 | 4.2 | 6.7 | 17.8 | 9.6 |
| 24 | 272 | 4.4 | 10.6 | 23.9 | 13.0 |
| 25 | 273 | nd | 14.0 | 18.1 | 16.1 |
| 26 | 274 | 8.7 | 10.1 | 33.0 | 17.3 |
| 27 | 275 | nd | 12.1 | 6.6 | 9.3 |
| 28 | 276 | nd | 13.0 | 13.4 | 13.2 |
| 29 | 277 | 5.7 | 10.6 | 24.5 | 13.6 |
| 30 | 278 | 18.9 | 16.6 | 39.4 | 25.0 |
| 31 | 279 | 3.8 | 5.4 | 9.4 | 6.2 |
| | BFIX | 22.9 | 27.3 | 53.8 | 34.7 |
| | BEFIX -T148 | 28.6 | 27.3 | 48.4 | 34.8 |
| | NFIX | 12.6 | nd | 16.8 | 14.7 |

Mean of production corresponds to 3 separated productions (except for mutants marked with * = only one production). Lower produced mutants are highlighted in grey.

In order to determine the bioactivity of each mutant, the clotting activity was measured by the one-stage activated partial thromboplastin time (aPTT) clotting assay (Cephascreen, Diagnostica Stago, France) using Factor IX immunodepleted human Deficient IX, Diagnostica Stago, France). Supernatants containing 60 ng of native or mutant Factor IX molecules from transient transfection production were diluted with 60 μL of immunodepleted plasma. 80 μL of Cephascreen reagent containing cephalin (platelet substitute) prepared from rabbit cerebral tissues and a polyphenolic activator in a buffered medium was added to dilute Factor IX samples and incubated at 37° C. for 15 minutes. Thus, 80 μL of pre-warmed $CaCl_2$ (0.025M, Diagnostica Stago, France) was added to Factor IX samples/Cephascreen reagent mix. The time required for clot formation was immediately monitored using a spectrophotometer (Spectramax, Molecular devices) at 350 nm. A serial dilution of normal human pooled plasma representing 100 to 120% of Factor IX activity (System control N, Diagnostica Stago, France) was used as the standard curve in order to validate the linearity of the clotting time detection. Data are presented in Table 18.

TABLE 18

Clotting activity of BFIX T148 SuperLEAD variants

| | | Production 1 | | Production 2 | | Production 3 | | |
|---|---|---|---|---|---|---|---|---|
| Rank | mutant number in BFIX-T148 matrix | T50 (clotting) (seconds) | conversion (μg/l) | T50 (clotting) (seconds) | conversion (μg/l) | T50 (clotting) (seconds) | conversion (μg/l) | MEAN OF T50 (clotting) (seconds) |
| 1 | 249 | 122 | 38.2 | 100 | 46.7 | 110 | 22.9 | 111 |
| 2 | 250 | 121 | 34.0 | 114 | 24.0 | 99 | 40.2 | 111 |
| 3 | 251 | 131 | 21.2 | 132 | 10.7 | 99 | 40.2 | 121 |
| 4 | 252 | 105 | 33.5 | 122 | 18.7 | 106 | 43.9 | 111 |
| 3 | 253 | 113 | 22.8 | 128 | 13.8 | 136 | 12.4 | 125 |
| 6 | 254 | 114 | 21.7 | 128 | 13.4 | 130 | 15.6 | 124 |
| 7 | 255 | 137 | 18.9 | 103 | 39.1 | 110 | 23.9 | 117 |
| 8 | 256 | 140 | 17.1 | 107 | 32.4 | 108 | 26.2 | 118 |
| 9 | 257 | nd | nd | nd | nd | 114 | 30.4 | 114* |
| 10 | 258 | 121 | 32.2 | 116 | 24.1 | 98 | 42.5 | 112 |

TABLE 18-continued

Clotting activity of BFIX T148 SuperLEAD variants

| | | Production 1 | | Production 2 | | Production 3 | | |
| --- | --- | --- | --- | --- | --- | --- | --- | --- |
| Rank | mutant number in BFIX-T148 matrix | T50 (clotting) (seconds) | conversion (µg/l) | T50 (clotting) (seconds) | conversion (µg/l) | T50 (clotting) (seconds) | conversion (µg/l) | MEAN OF T50 (clotting) (seconds) |
| 11 | 259 | nd | nd | 109 | 29.6 | 130 | 15.7 | 119 |
| 12 | 260 | 128 | 23.4 | 120 | 17.9 | 101 | 36.7 | 117 |
| 13 | 261 | 144 | 14.9 | 115 | 21.8 | 110 | 23.1 | 123 |
| 14 | 262 | nd | nd | nd | nd | 133 | 13.9 | 133* |
| 15 | 263 | 118 | 23.3 | 100 | 51.3 | 115 | 18.7 | 111 |
| 16 | 264 | 118 | 37.7 | 108 | 34.9 | 109 | 39.2 | 111 |
| 17 | 265 | nd | nd | 106 | 34.1 | 120 | 23.0 | 113 |
| 18 | 266 | 138 | 19.6 | 115 | 21.5 | 100 | 39.6 | 118 |
| 19 | 267 | 115 | 21.3 | 123 | 16.7 | 128 | 16.5 | 122 |
| 20 | 268 | nd | nd | nd | nd | 126 | 18.5 | 126* |
| 21 | 269 | 115 | 24.9 | 110 | 28.8 | 105 | 30.5 | 110 |
| 22 | 270 | 120 | 19.8 | 118 | 19.8 | 116 | 17.5 | 118 |
| 23 | 271 | 133 | 11.4 | 106 | 34.2 | 115 | 18.1 | 118 |
| 24 | 272 | 125 | 15.5 | 116 | 21.8 | 120 | 14.9 | 120 |
| 25 | 273 | nd | nd | 125 | 14.6 | 128 | 16.8 | 126 |
| 26 | 274 | 118 | 21.7 | 102 | 45.3 | 109 | 24.4 | 109 |
| 27 | 275 | nd | nd | 135 | 10.5 | 147 | 8.1 | 141 |
| 28 | 276 | nd | nd | 123 | 17.1 | 135 | 12.9 | 129 |
| 29 | 277 | 127 | 14.8 | 116 | 21.6 | 102 | 34.5 | 113 |
| 30 | 278 | 136 | 17.8 | 129 | 12.6 | 135 | 12.6 | 133 |
| 31 | 279 | 128 | 28.4 | 102 | 39.9 | 113 | 20.7 | 114 |
| | BFIX | 107 | 48 | 103 | 44 | | | 105 |
| | BFIX-T148 | 116 | 32 | 104 | 42 | 120 | 15.0 | 113 |
| | NFIX | 128 | 19 | 117 | 21 | | | 123 |

Mean of production corresponds to 3 separated clotting time assays (except for mutants marked with * = only one production).
Conversion in µg/L was based from standard curves obtained from normal human sera.

All selected mutants in BFIX-T148 background were active by clotting time assays and were similar to BFIX-T148 native sequence ($t_{1/2}$ between 111 sec and 133 sec). Only mutant 275 exhibited a clotting time higher than 140 sec.

Since modifications will be apparent to those of skill in this art, it is intended the this invention be limited only by the scope of the appended claims.

SEQUENCE LISTING (2044 sequences)

SEQ ID NO: 1 - protein, 461 aa, Homo sapiens
  FIX WT
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2 - protein, 415 aa, Homo sapiens
  FIX_WT Mature
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 3 - protein, 415 aa, Homo sapiens
  FIX_Y1H
HNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 4 - protein, 415 aa, Homo sapiens
  FIX_Y1I
INSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 5 - protein, 415 aa, Homo sapiens
  FIX_K5N
YNSGNLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 6 - protein, 415 aa, Homo sapiens
  FIX_K5Q
YNSGQLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 7 - protein, 415 aa, Homo sapiens
  FIX_L6I
YNSGKIEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 8 - protein, 415 aa, Homo sapiens
  FIX_L6V
YNSGKVEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 9 - protein, 415 aa, Homo sapiens
  FIX_E7Q
YNSGKLQEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 10 - protein, 415 aa, Homo sapiens
  FIX_E7H
YNSGKLHEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 11 - protein, 415 aa, Homo sapiens
  FIX_E7N
YNSGKLNEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 12 - protein, 415 aa, Homo sapiens
  FIX_E8Q
YNSGKLEQFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 13 - protein, 415 aa, Homo sapiens
  FIX_E8H
YNSGKLEHFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 14 - protein, 415 aa, Homo sapiens
  FIX_E8N
YNSGKLENFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 15 - protein, 415 aa, Homo sapiens
  FIX_F9I
YNSGKLEEIVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 16 - protein, 415 aa, Homo sapiens
  FIX_F9V
YNSGKLEEVVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 17 - protein, 415 aa, Homo sapiens
  FIX_L14I
YNSGKLEEFVQGNIERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 18 - protein, 415 aa, Homo sapiens
  FIX_L14V
YNSGKLEEFVQGNVERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 19 - protein, 415 aa, Homo sapiens
  FIX_E15Q
YNSGKLEEFVQGNLQRECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 20 - protein, 415 aa, Homo sapiens
  FIX_E15H
YNSGKLEEFVQGNLHRECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 21 - protein, 415 aa, Homo sapiens
  FIX_E15N
YNSGKLEEFVQGNLNRECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 22 - protein, 415 aa, Homo sapiens
  FIX_R16H
YNSGKLEEFVQGNLEHECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 23 - protein, 415 aa, Homo sapiens
  FIX_R16Q
YNSGKLEEFVQGNLEQECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 24 - protein, 415 aa, Homo sapiens
  FIX_E17Q
YNSGKLEEFVQGNLERQCMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 25 - protein, 415 aa, Homo sapiens
  FIX_E17H
YNSGKLEEFVQGNLERHCMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 26 - protein, 415 aa, Homo sapiens
  FIX_E17N
YNSGKLEEFVQGNLERNCMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 27 - protein, 415 aa, Homo sapiens
  FIX_M19I
YNSGKLEEFVQGNLERECIEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 28 - protein, 415 aa, Homo sapiens
  FIX_M19V
YNSGKLEEFVQGNLERECVEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 29 - protein, 415 aa, Homo sapiens
  FIX_E20Q
YNSGKLEEFVQGNLERECMQEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 30 - protein, 415 aa, Homo sapiens
  FIX_E20H
YNSGKLEEFVQGNLERECMHEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 31 - protein, 415 aa, Homo sapiens
  FIX_E20N
YNSGKLEEFVQGNLERECMNEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 32 - protein, 415 aa, Homo sapiens
  FIX_E21Q
YNSGKLEEFVQGNLERECMEQKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 33 - protein, 415 aa, Homo sapiens
  FIX_E21H
YNSGKLEEFVQGNLERECMEHKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 34 - protein, 415 aa, Homo sapiens
  FIX_E21N
YNSGKLEEFVQGNLERECMENKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 35 - protein, 415 aa, Homo sapiens
  FIX_K22N
YNSGKLEEFVQGNLERECMEENCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 36 - protein, 415 aa, Homo sapiens
  FIX_K22Q
YNSGKLEEFVQGNLERECMEEQCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 37 - protein, 415 aa, Homo sapiens
  FIX_F25I
YNSGKLEEFVQGNLERECMEEKCSIEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 38 - protein, 415 aa, Homo sapiens
  FIX_F25V
YNSGKLEEFVQGNLERECMEEKCSVEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 39 - protein, 415 aa, Homo sapiens
  FIX_E26Q
YNSGKLEEFVQGNLERECMEEKCSFQEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 40 - protein, 415 aa, Homo sapiens
  FIX_E26H
YNSGKLEEFVQGNLERECMEEKCSFHEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 41 - protein, 415 aa, Homo sapiens
  FIX_E26N
YNSGKLEEFVQGNLERECMEEKCSFNEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 42 - protein, 415 aa, Homo sapiens
  FIX_E27Q
YNSGKLEEFVQGNLERECMEEKCSFEQAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 43 - protein, 415 aa, Homo sapiens
  FIX_E27H
YNSGKLEEFVQGNLERECMEEKCSFEHAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 44 - protein, 415 aa, Homo sapiens
  FIX_E27N
YNSGKLEEFVQGNLERECMEEKCSFENAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 45 - protein, 415 aa, Homo sapiens
  FIX_R29H
YNSGKLEEFVQGNLERECMEEKCSFEEAHEVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 46 - protein, 415 aa, Homo sapiens
  FIX_R29Q
YNSGKLEEFVQGNLERECMEEKCSFEEAQEVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 47 - protein, 415 aa, Homo sapiens
  FIX_E30Q
YNSGKLEEFVQGNLERECMEEKCSFEEARQVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 48 - protein, 415 aa, Homo sapiens
  FIX_E30H
YNSGKLEEFVQGNLERECMEEKCSFEEARHVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 49 - protein, 415 aa, Homo sapiens
  FIX_E30N
YNSGKLEEFVQGNLERECMEEKCSFEEARNVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 50 - protein, 415 aa, Homo sapiens
  FIX_F32I
YNSGKLEEFVQGNLERECMEEKCSFEEAREVIENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 51 - protein, 415 aa, Homo sapiens
  FIX_F32V
YNSGKLEEFVQGNLERECMEEKCSFEEAREVVENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 52 - protein, 415 aa, Homo sapiens
  FIX_E33Q
YNSGKLEEFVQGNLERECMEEKCSFEEAREVFQNTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 53 - protein, 415 aa, Homo sapiens
  FIX_E33H
YNSGKLEEFVQGNLERECMEEKCSFEEAREVFHNTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 54 - protein, 415 aa, Homo sapiens
  FIX_E33N
YNSGKLEEFVQGNLERECMEEKCSFEEAREVFNNTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 55 - protein, 415 aa, Homo sapiens
  FIX_E36Q
YNSGKLEEFVQGNLERECMEEKCSFEEAREVFENTQRTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 56 - protein, 415 aa, Homo sapiens
  FIX_E36H
YNSGKLEEFVQGNLERECMEEKCSFEEAREVFENTHRTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 57 - protein, 415 aa, Homo sapiens
  FIX_E36N
YNSGKLEEFVQGNLERECMEEKCSFEEAREVFENTNRTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 58 - protein, 415 aa, Homo sapiens
  FIX_R37H
YNSGKLEEFVQGNLERECMEEKCSFEEAREVFENTEHTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 59 - protein, 415 aa, Homo sapiens
  FIX_R37Q
YNSGKLEEFVQGNLERECMEEKCSFEEAREVFENTEQTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 60 - protein, 415 aa, Homo sapiens
  FIX_E40Q
YNSGKLEEFVQGNLERECMEEKCSFEEAREVFENTERTTQFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 61 - protein, 415 aa, Homo sapiens
  FIX_E40H
YNSGKLEEFVQGNLERECMEEKCSFEEAREVFENTERTTHFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 62 - protein, 415 aa, Homo sapiens
  FIX_E40N
YNSGKLEEFVQGNLERECMEEKCSFEEAREVFENTERTTNFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 63 - protein, 415 aa, Homo sapiens
  FIX_F41I
YNSGKLEEFVQGNLERECMEEKCSFEEAREVFENTERTTEIWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 64 - protein, 415 aa, Homo sapiens
  FIX_F41V
YNSGKLEEFVQGNLERECMEEKCSFEEAREVFENTERTTEVWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 65 - protein, 415 aa, Homo sapiens
  FIX_W42S
YNSGKLEEFVQGNLERECMEEKCSFEEAREVFENTERTTEFSKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 66 - protein, 415 aa, Homo sapiens
  FIX_W42H
YNSGKLEEFVQGNLERECMEEKCSFEEAREVFENTERTTEFHKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 67 - protein, 415 aa, Homo sapiens
  FIX_K43N
YNSGKLEEFVQGNLERECMEEKCSFEEAREVFENTERTTEFWNQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 68 - protein, 415 aa, Homo sapiens
  FIX_K43Q
YNSGKLEEFVQGNLERECMEEKCSFEEAREVFENTERTTEFWQQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 69 - protein, 415 aa, Homo sapiens
  FIX_Y45H
YNSGKLEEFVQGNLERECMEEKCSFEEAREVFENTERTTEFWKQHVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 70 - protein, 415 aa, Homo sapiens
  FIX_Y45I
YNSGKLEEFVQGNLERECMEEKCSFEEAREVFENTERTTEFWKQIVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 71 - protein, 415 aa, Homo sapiens
  FIX_D47N
YNSGKLEEFVQGNLERECMEEKCSFEEAREVFENTERTTEFWKQYVNGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 72 - protein, 415 aa, Homo sapiens
  FIX_D47Q
YNSGKLEEFVQGNLERECMEEKCSFEEAREVFENTERTTEFWKQYVQGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 73 - protein, 415 aa, Homo sapiens
  FIX_D49N
YNSGKLEEFVQGNLERECMEEKCSFEEAREVFENTERTTEFWKQYVDGNQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 74 - protein, 415 aa, Homo sapiens
  FIX_D49Q
YNSGKLEEFVQGNLERECMEEKCSFEEAREVFENTERTTEFWKQYVDGQQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 75 - protein, 415 aa, Homo sapiens
  FIX_E52Q
YNSGKLEEFVQGNLERECMEEKCSFEEAREVFENTERTTEFWKQYVDGDQCQSNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 76 - protein, 415 aa, Homo sapiens
  FIX_E52H
YNSGKLEEFVQGNLERECMEEKCSFEEAREVFENTERTTEFWKQYVDGDQCHSNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 77 - protein, 415 aa, Homo sapiens
  FIX_E52N
YNSGKLEEFVQGNLERECMEEKCSFEEAREVFENTERTTEFWKQYVDGDQCNSNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 78 - protein, 415 aa, Homo sapiens
  FIX_P55A
YNSGKLEEFVQGNLERECMEEKCSFEEAREVFENTERTTEFWKQYVDGDQCESNACLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 79 - protein, 415 aa, Homo sapiens
  FIX_P55S
YNSGKLEEFVQGNLERECMEEKCSFEEAREVFENTERTTEFWKQYVDGDQCESNSCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 80 - protein, 415 aa, Homo sapiens
  FIX_L57I
YNSGKLEEFVQGNLERECMEEKCSFEEAREVFENTERTTEFWKQYVDGDQCESNPCINGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 81 - protein, 415 aa, Homo sapiens
  FIX_L57V
YNSGKLEEFVQGNLERECMEEKCSFEEAREVFENTERTTEFWKQYVDGDQCESNPCVNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 82 - protein, 415 aa, Homo sapiens
  FIX_N58Q
YNSGKLEEFVQGNLERECMEEKCSFEEAREVFENTERTTEFWKQYVDGDQCESNPCLQGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 83 - protein, 415 aa, Homo sapiens
  FIX_N58S
YNSGKLEEFVQGNLERECMEEKCSFEEAREVFENTERTTEFWKQYVDGDQCESNPCLSGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 84 - protein, 415 aa, Homo sapiens
  FIX_K63N
YNSGKLEEFVQGNLERECMEEKCSFEEAREVFENTERTTEFWKQYVDGDQCESNPCLNGGSCNDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 85 - protein, 415 aa, Homo sapiens
  FIX_K63Q
YNSGKLEEFVQGNLERECMEEKCSFEEAREVFENTERTTEFWKQYVDGDQCESNPCLNGGSCQDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 86 - protein, 415 aa, Homo sapiens
  FIX_D64N
YNSGKLEEFVQGNLERECMEEKCSFEEAREVFENTERTTEFWKQYVDGDQCESNPCLNGGSCKNDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 87 - protein, 415 aa, Homo sapiens
  FIX_D64Q
YNSGKLEEFVQGNLERECMEEKCSFEEAREVFENTERTTEFWKQYVDGDQCESNPCLNGGSCKQDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 88 - protein, 415 aa, Homo sapiens
  FIX_D65N
YNSGKLEEFVQGNLERECMEEKCSFEEAREVFENTERTTEFWKQYVDGDQCESNPCLNGGSCKDNINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 89 - protein, 415 aa, Homo sapiens
  FIX_D65Q
YNSGKLEEFVQGNLERECMEEKCSFEEAREVFENTERTTEFWKQYVDGDQCESNPCLNGGSCKDQINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 90 - protein, 415 aa, Homo sapiens
  FIX_Y69H
YNSGKLEEFVQGNLERECMEEKCSFEEAREVFENTERTTEFWKQYVDGDQCESNPCLNGGSCKDDINSHECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 91 - protein, 415 aa, Homo sapiens
  FIX_Y69I
YNSGKLEEFVQGNLERECMEEKCSFEEAREVFENTERTTEFWKQYVDGDQCESNPCLNGGSCKDDINSIECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 92 - protein, 415 aa, Homo sapiens
  FIX_E70Q
YNSGKLEEFVQGNLERECMEEKCSFEEAREVFENTERTTEFWKQYVDGDQCESNPCLNGGSCKDDINSYQCWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 93 - protein, 415 aa, Homo sapiens
  FIX_E70H
YNSGKLEEFVQGNLERECMEEKCSFEEAREVFENTERTTEFWKQYVDGDQCESNPCLNGGSCKDDINSYHCWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 94 - protein, 415 aa, Homo sapiens
  FIX_E70N
YNSGKLEEFVQGNLERECMEEKCSFEEAREVFENTERTTEFWKQYVDGDQCESNPCLNGGSCKDDINSYNCWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 95 - protein, 415 aa, Homo sapiens
  FIX_W72S
YNSGKLEEFVQGNLERECMEEKCSFEEAREVFENTERTTEFWKQYVDGDQCESNPCLNGGSCKDDINSYECSCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 96 - protein, 415 aa, Homo sapiens
  FIX_W72H
YNSGKLEEFVQGNLERECMEEKCSFEEAREVFENTERTTEFWKQYVDGDQCESNPCLNGGSCKDDINSYECHCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 97 - protein, 415 aa, Homo sapiens
  FIX_P74A
YNSGKLEEFVQGNLERECMEEKCSFEEAREVFENTERTTEFWKQYVDGDQCESNPCLNGGSCKDDINSYECWCAFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 98 - protein, 415 aa, Homo sapiens
  FIX_P74S
YNSGKLEEFVQGNLERECMEEKCSFEEAREVFENTERTTEFWKQYVDGDQCESNPCLNGGSCKDDINSYECWCSFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 99 - protein, 415 aa, Homo sapiens
  FIX_F75I
YNSGKLEEFVQGNLERECMEEKCSFEEAREVFENTERTTEFWKQYVDGDQCESNPCLNGGSCKDDINSYECWCPIGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 100 - protein, 415 aa, Homo sapiens
  FIX_F75V
YNSGKLEEFVQGNLERECMEEKCSFEEAREVFENTERTTEFWKQYVDGDQCESNPCLNGGSCKDDINSYECWCPVGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 101 - protein, 415 aa, Homo sapiens
  FIX_F77I
YNSGKLEEFVQGNLERECMEEKCSFEEAREVFENTERTTEFWKQYVDGDQCESNPCLNGGSCKDDINSYECWCPFGIEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 102 - protein, 415 aa, Homo sapiens
  FIX_F77V
YNSGKLEEFVQGNLERECMEEKCSFEEAREVFENTERTTEFWKQYVDGDQCESNPCLNGGSCKDDINSYECWCPFGVEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 103 - protein, 415 aa, Homo sapiens
  FIX_E78Q
YNSGKLEEFVQGNLERECMEEKCSFEEAREVFENTERTTEFWKQYVDGDQCESNPCLNGGSCKDDINSYECWCPFGFQGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 104 - protein, 415 aa, Homo sapiens
  FIX_E78H
YNSGKLEEFVQGNLERECMEEKCSFEEAREVFENTERTTEFWKQYVDGDQCESNPCLNGGSCKDDINSYECWCPFGFHGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 105 - protein, 415 aa, Homo sapiens
  FIX_E78N
YNSGKLEEFVQGNLERECMEEKCSFEEAREVFENTERTTEFWKQYVDGDQCESNPCLNGGSCKDDINSYECWCPFGFNGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 106 - protein, 415 aa, Homo sapiens
  FIX_K80N
YNSGKLEEFVQGNLERECMEEKCSFEEAREVFENTERTTEFWKQYVDGDQCESNPCLNGGSCKDDINSYECWCPFGFEGNNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 107 - protein, 415 aa, Homo sapiens
  FIX_K80Q
YNSGKLEEFVQGNLERECMEEKCSFEEAREVFENTERTTEFWKQYVDGDQCESNPCLNGGSCKDDINSYECWCPFGFEGQNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 108 - protein, 415 aa, Homo sapiens
  FIX_E83Q
YNSGKLEEFVQGNLERECMEEKCSFEEAREVFENTERTTEFWKQYVDGDQCESNPCLNGGSCKDDINSYECWCPFGFEGKNCQLDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 109 - protein, 415 aa, Homo sapiens
  FIX_E83H
YNSGKLEEFVQGNLERECMEEKCSFEEAREVFENTERTTEFWKQYVDGDQCESNPCLNGGSCKDDINSYECWCPFGFEGKNCHLDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 110 - protein, 415 aa, Homo sapiens
  FIX_E83N
YNSGKLEEFVQGNLERECMEEKCSFEEAREVFENTERTTEFWKQYVDGDQCESNPCLNGGSCKDDINSYECWCPFGFEGKNCNLDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 111 - protein, 415 aa, Homo sapiens
  FIX_L84I
YNSGKLEEFVQGNLERECMEEKCSFEEAREVFENTERTTEFWKQYVDGDQCESNPCLNGGSCKDDINSYECWCPFGFEGKNCEIDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 112 - protein, 415 aa, Homo sapiens
  FIX_L84V
YNSGKLEEFVQGNLERECMEEKCSFEEAREVFENTERTTEFWKQYVDGDQCESNPCLNGGSCKDDINSYECWCPFGFEGKNCEVDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 113 - protein, 415 aa, Homo sapiens
  FIX_D85N
YNSGKLEEFVQGNLERECMEEKCSFEEAREVFENTERTTEFWKQYVDGDQCESNPCLNGGSCKDDINSYECWCPFGFEGKNCELNVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 114 - protein, 415 aa, Homo sapiens
  FIX_D85Q
YNSGKLEEFVQGNLERECMEEKCSFEEAREVFENTERTTEFWKQYVDGDQCESNPCLNGGSCKDDINSYECWCPFGFEGKNCELQVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 115 - protein, 415 aa, Homo sapiens
  FIX_K91N
YNSGKLEEFVQGNLERECMEEKCSFEEAREVFENTERTTEFWKQYVDGDQCESNPCLNGGSCKDDINSYECWCPFGFEGKNCELDVTCNINNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 116 - protein, 415 aa, Homo sapiens
  FIX_K91Q
YNSGKLEEFVQGNLERECMEEKCSFEEAREVFENTERTTEFWKQYVDGDQCESNPCLNGGSCKDDINSYECWCPFGFEGKNCELDVTCNIQNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 117 - protein, 415 aa, Homo sapiens
  FIX_N92Q
YNSGKLEEFVQGNLERECMEEKCSFEEAREVFENTERTTEFWKQYVDGDQCESNPCLNGGSCKDDINSYECWCPFGFEGKNCELDVTCNIKQGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 118 - protein, 415 aa, Homo sapiens
  FIX_N92S
YNSGKLEEFVQGNLERECMEEKCSFEEAREVFENTERTTEFWKQYVDGDQCESNPCLNGGSCKDDINSYECWCPFGFEGKNCELDVTCNIKSGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 119 - protein, 415 aa, Homo sapiens
  FIX_R94H
YNSGKLEEFVQGNLERECMEEKCSFEEAREVFENTERTTEFWKQYVDGDQCESNPCLNGGSCKDDINSYECWCPFGFEGKNCELDVTCNIKNGHCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 120 - protein, 415 aa, Homo sapiens
  FIX_R94Q
YNSGKLEEFVQGNLERECMEEKCSFEEAREVFENTERTTEFWKQYVDGDQCESNPCLNGGSCKDDINSYECWCPFGFEGKNCELDVTCNIKNGQCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 121 - protein, 415 aa, Homo sapiens
  FIX_E96Q
YNSGKLEEFVQGNLERECMEEKCSFEEAREVFENTERTTEFWKQYVDGDQCESNPCLNGGSCKDDINSYECWCPFGFEGKNCELDVTCNIKNGRCQQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 122 - protein, 415 aa, Homo sapiens
  FIX_E96H
YNSGKLEEFVQGNLERECMEEKCSFEEAREVFENTERTTEFWKQYVDGDQCESNPCLNGGSCKDDINSYECWCPFGFEGKNCELDVTCNIKNGRCHQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 123 - protein, 415 aa, Homo sapiens
  FIX_E96N
YNSGKLEEFVQGNLERECMEEKCSFEEAREVFENTERTTEFWKQYVDGDQCESNPCLNGGSCKDDINSYECWCPFGFEGKNCELDVTCNIKNGRCNQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 124 - protein, 415 aa, Homo sapiens
  FIX_F98I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQICKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 125 - protein, 415 aa, Homo sapiens
  FIX_F98V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQVCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 126 - protein, 415 aa, Homo sapiens
  FIX_K100N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCNNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 127 - protein, 415 aa, Homo sapiens
  FIX_K100Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCQNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 128 - protein, 415 aa, Homo sapiens
  FIX_D104N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 129 - protein, 415 aa, Homo sapiens
  FIX_D104Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSAQNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 130 - protein, 415 aa, Homo sapiens
  FIX_K106N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNNVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 131 - protein, 415 aa, Homo sapiens
  FIX_K106Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNQVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 132 - protein, 415 aa, Homo sapiens
  FIX_E113Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTQGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 133 - protein, 415 aa, Homo sapiens
  FIX_E113H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTHGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 134 - protein, 415 aa, Homo sapiens
  FIX_E113N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTNGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 135 - protein, 415 aa, Homo sapiens
  FIX_Y115H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGHRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 136 - protein, 415 aa, Homo sapiens
  FIX_Y115I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGIRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 137 - protein, 415 aa, Homo sapiens
  FIX_R116H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYHLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 138 - protein, 415 aa, Homo sapiens
  FIX_R116Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYQLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 139 - protein, 415 aa, Homo sapiens
  FIX_L117I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRIAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 140 - protein, 415 aa, Homo sapiens
  FIX_L117V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRVAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 141 - protein, 415 aa, Homo sapiens
  FIX_E119Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAQNQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 142 - protein, 415 aa, Homo sapiens
  FIX_E119H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAHNQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 143 - protein, 415 aa, Homo sapiens
  FIX_E119N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLANNQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 144 - protein, 415 aa, Homo sapiens
  FIX_K122N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQNSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 145 - protein, 415 aa, Homo sapiens
  FIX_K122Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQQSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 146 - protein, 415 aa, Homo sapiens
  FIX_E125Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCQPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 147 - protein, 415 aa, Homo sapiens
  FIX_E125H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCHPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 148 - protein, 415 aa, Homo sapiens
  FIX_E125N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCNPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 149 - protein, 415 aa, Homo sapiens
  FIX_P126A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEAAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 150 - protein, 415 aa, Homo sapiens
  FIX_P126S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCESAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 151 - protein, 415 aa, Homo sapiens
  FIX_P129A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVAFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 152 - protein, 415 aa, Homo sapiens
  FIX_P129S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVSFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 153 - protein, 415 aa, Homo sapiens
  FIX_P131A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFACGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 154 - protein, 415 aa, Homo sapiens
  FIX_P131S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFSCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 155 - protein, 415 aa, Homo sapiens
  FIX_R134H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGHVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 156 - protein, 415 aa, Homo sapiens
  FIX_R134Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGQVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 157 - protein, 415 aa, Homo sapiens
  FIX_K142N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSNLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 158 - protein, 415 aa, Homo sapiens
  FIX_K142Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSQLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 159 - protein, 415 aa, Homo sapiens
  FIX_L143I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKITRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 160 - protein, 415 aa, Homo sapiens
  FIX_L143V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKVTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 161 - protein, 415 aa, Homo sapiens
  FIX_R145H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTHAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 162 - protein, 415 aa, Homo sapiens
  FIX_R145Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTQAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 163 - protein, 415 aa, Homo sapiens
  FIX_E147Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAQTVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 164 - protein, 415 aa, Homo sapiens
  FIX_E147H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAHTVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 165 - protein, 415 aa, Homo sapiens
  FIX_E147N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRANTVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 166 - protein, 415 aa, Homo sapiens
  FIX_P151A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFADVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 167 - protein, 415 aa, Homo sapiens
  FIX_P151S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFSDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 168 - protein, 415 aa, Homo sapiens
  FIX_D152N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPNVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 169 - protein, 415 aa, Homo sapiens
  FIX_D152Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPQVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 170 - protein, 415 aa, Homo sapiens
  FIX_D154N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVNYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 171 - protein, 415 aa, Homo sapiens
  FIX_D154Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVQYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 172 - protein, 415 aa, Homo sapiens
  FIX_Y155H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDHVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 173 - protein, 415 aa, Homo sapiens
  FIX_Y155I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDIVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 174 - protein, 415 aa, Homo sapiens
  FIX_E160Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTQAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 175 - protein, 415 aa, Homo sapiens
  FIX_E160H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTHAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 176 - protein, 415 aa, Homo sapiens
  FIX_E160N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTNAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 177 - protein, 415 aa, Homo sapiens
  FIX_E162Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAQTILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 178 - protein, 415 aa, Homo sapiens
  FIX_E162H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAHTILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 179 - protein, 415 aa, Homo sapiens
  FIX_E162N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEANTILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 180 - protein, 415 aa, Homo sapiens
  FIX_L165I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETIIDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 181 - protein, 415 aa, Homo sapiens
  FIX_L165V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETIVDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 182 - protein, 415 aa, Homo sapiens
  FIX_D166N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 183 - protein, 415 aa, Homo sapiens
  FIX_D166Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 184 - protein, 415 aa, Homo sapiens
  FIX_F175I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSINDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 185 - protein, 415 aa, Homo sapiens
  FIX_F175V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSVNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 186 - protein, 415 aa, Homo sapiens
  FIX_D177N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNNFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 187 - protein, 415 aa, Homo sapiens
  FIX_D177Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNQFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 188 - protein, 415 aa, Homo sapiens
  FIX_F178I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDITRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 189 - protein, 415 aa, Homo sapiens
  FIX_F178V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDVTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 190 - protein, 415 aa, Homo sapiens
  FIX_R180H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTHVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 191 - protein, 415 aa, Homo sapiens
  FIX_R180Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTQVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 192 - protein, 415 aa, Homo sapiens
  FIX_E185Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGQDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 193 - protein, 415 aa, Homo sapiens
  FIX_E185H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGHDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 194 - protein, 415 aa, Homo sapiens
  FIX_E185N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGNDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 195 - protein, 415 aa, Homo sapiens
  FIX_D186N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGENAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 196 - protein, 415 aa, Homo sapiens
  FIX_D186Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEQAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 197 - protein, 415 aa, Homo sapiens
  FIX_K188N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDANPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 198 - protein, 415 aa, Homo sapiens
  FIX_K188Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAQPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 199 - protein, 415 aa, Homo sapiens
  FIX_P189A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKAGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 200 - protein, 415 aa, Homo sapiens
  FIX_P189S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKSGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 201 - protein, 415 aa, Homo sapiens
  FIX_P193A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFAWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 202 - protein, 415 aa, Homo sapiens
  FIX_P193S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFSWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 203 - protein, 415 aa, Homo sapiens
  FIX_W194S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPSQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 204 - protein, 415 aa, Homo sapiens
  FIX_W194H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPHQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 205 - protein, 415 aa, Homo sapiens
  FIX_L198I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVINGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 206 - protein, 415 aa, Homo sapiens
  FIX_L198V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVVNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 207 - protein, 415 aa, Homo sapiens
  FIX_N199Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLQGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 208 - protein, 415 aa, Homo sapiens
  FIX_N199S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLSGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 209 - protein, 415 aa, Homo sapiens
  FIX_K201N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGNVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 210 - protein, 415 aa, Homo sapiens
  FIX_K201Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGQVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 211 - protein, 415 aa, Homo sapiens
  FIX_D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 212 - protein, 415 aa, Homo sapiens
  FIX_D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 213 - protein, 415 aa, Homo sapiens
  FIX_F205I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAICGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 214 - protein, 415 aa, Homo sapiens
  FIX_F205V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAVCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 215 - protein, 415 aa, Homo sapiens
  FIX_E213Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNQKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 216 - protein, 415 aa, Homo sapiens
  FIX_E213H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNHKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 217 - protein, 415 aa, Homo sapiens
  FIX_E213N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNNKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 218 - protein, 415 aa, Homo sapiens
  FIX_K214N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNENWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 219 - protein, 415 aa, Homo sapiens
  FIX_K214Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEQWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 220 - protein, 415 aa, Homo sapiens
  FIX_W215S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKSIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 221 - protein, 415 aa, Homo sapiens
  FIX_W215H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKHIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 222 - protein, 415 aa, Homo sapiens
  FIX_E224Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVQTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 223 - protein, 415 aa, Homo sapiens
  FIX_E224H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVHTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 224 - protein, 415 aa, Homo sapiens
  FIX_E224N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVNTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 225 - protein, 415 aa, Homo sapiens
  FIX_K228N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 226 - protein, 415 aa, Homo sapiens
  FIX_K228Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVQITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 227 - protein, 415 aa, Homo sapiens
  FIX_E235Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGQHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 228 - protein, 415 aa, Homo sapiens
  FIX_E235H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGHHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 229 - protein, 415 aa, Homo sapiens
  FIX_E235N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGNHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 230 - protein, 415 aa, Homo sapiens
  FIX_E239Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIQETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 231 - protein, 415 aa, Homo sapiens
  FIX_E239H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIHETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 232 - protein, 415 aa, Homo sapiens
  FIX_E239N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNINETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 233 - protein, 415 aa, Homo sapiens
  FIX_E240Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEQTEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 234 - protein, 415 aa, Homo sapiens
  FIX_E240H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEHTEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 235 - protein, 415 aa, Homo sapiens
  FIX_E240N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIENTEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 236 - protein, 415 aa, Homo sapiens
  FIX_E242Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETQHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 237 - protein, 415 aa, Homo sapiens
  FIX_E242H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETHHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 238 - protein, 415 aa, Homo sapiens
  FIX_E242N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETNHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 239 - protein, 415 aa, Homo sapiens
  FIX_E245Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTQQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 240 - protein, 415 aa, Homo sapiens
  FIX_E245H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTHQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 241 - protein, 415 aa, Homo sapiens
  FIX_E245N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTNQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 242 - protein, 415 aa, Homo sapiens
  FIX_K247N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 243 - protein, 415 aa, Homo sapiens
  FIX_K247Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQQRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 244 - protein, 415 aa, Homo sapiens
  FIX_R248H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKHNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 245 - protein, 415 aa, Homo sapiens
  FIX_R248Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKQNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 246 - protein, 415 aa, Homo sapiens
  FIX_R252H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIHIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 247 - protein, 415 aa, Homo sapiens
  FIX_R252Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIQIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 248 - protein, 415 aa, Homo sapiens
  FIX_P255A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIAHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 249 - protein, 415 aa, Homo sapiens
  FIX_P255S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIISHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 250 - protein, 415 aa, Homo sapiens
  FIX_Y259H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNHNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 251 - protein, 415 aa, Homo sapiens
  FIX_Y259I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNINAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 252 - protein, 415 aa, Homo sapiens
  FIX_K265N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINNYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 253 - protein, 415 aa, Homo sapiens
  FIX_K265Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINQYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 254 - protein, 415 aa, Homo sapiens
  FIX_Y266H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKHNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 255 - protein, 415 aa, Homo sapiens
  FIX_Y266I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKINHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 256 - protein, 415 aa, Homo sapiens
  FIX_D269N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHNIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 257 - protein, 415 aa, Homo sapiens
  FIX_D269Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHQIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 258 - protein, 415 aa, Homo sapiens
  FIX_L272I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIAILELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 259 - protein, 415 aa, Homo sapiens
  FIX_L272V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIAVLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 260 - protein, 415 aa, Homo sapiens
  FIX_L273I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALIELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 261 - protein, 415 aa, Homo sapiens
  FIX_L273V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALVELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 262 - protein, 415 aa, Homo sapiens
  FIX_E274Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLQLDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 263 - protein, 415 aa, Homo sapiens
  FIX_E274H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLHLDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 264 - protein, 415 aa, Homo sapiens
  FIX_E274N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLNLDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 265 - protein, 415 aa, Homo sapiens
  FIX_L275I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLEIDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 266 - protein, 415 aa, Homo sapiens
  FIX_L275V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLEVDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 267 - protein, 415 aa, Homo sapiens
  FIX_D276N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELNEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 268 - protein, 415 aa, Homo sapiens
  FIX_D276Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELQEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 269 - protein, 415 aa, Homo sapiens
  FIX_E277Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDQPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 270 - protein, 415 aa, Homo sapiens
  FIX_E277H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDHPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 271 - protein, 415 aa, Homo sapiens
  FIX_E277N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDNPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 272 - protein, 415 aa, Homo sapiens
  FIX_P278A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEALVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 273 - protein, 415 aa, Homo sapiens
  FIX_P278S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDESLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 274 - protein, 415 aa, Homo sapiens
  FIX_L279I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPIVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 275 - protein, 415 aa, Homo sapiens
  FIX_L279V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPVVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 276 - protein, 415 aa, Homo sapiens
  FIX_L281I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVINSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 277 - protein, 415 aa, Homo sapiens
  FIX_L281V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVVNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 278 - protein, 415 aa, Homo sapiens
  FIX_Y284H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSHVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 279 - protein, 415 aa, Homo sapiens
  FIX_Y284I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSIVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 280 - protein, 415 aa, Homo sapiens
  FIX_P287A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTAICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 281 - protein, 415 aa, Homo sapiens
  FIX_P287S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTSICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 282 - protein, 415 aa, Homo sapiens
  FIX_D292N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIANKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 283 - protein, 415 aa, Homo sapiens
  FIX_D292Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIAQKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 284 - protein, 415 aa, Homo sapiens
  FIX_K293N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADNEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 285 - protein, 415 aa, Homo sapiens
  FIX_K293Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADQEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 286 - protein, 415 aa, Homo sapiens
  FIX_E294Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKQYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 287 - protein, 415 aa, Homo sapiens
  FIX_E294H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKHYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 288 - protein, 415 aa, Homo sapiens
  FIX_E294N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKNYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 289 - protein, 415 aa, Homo sapiens
  FIX_Y295H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEHTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 290 - protein, 415 aa, Homo sapiens
  FIX_Y295I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEITNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 291 - protein, 415 aa, Homo sapiens
  FIX_F299I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIILKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 292 - protein, 415 aa, Homo sapiens
  FIX_F299V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIVLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 293 - protein, 415 aa, Homo sapiens
  FIX_L300I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFIKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 294 - protein, 415 aa, Homo sapiens
  FIX_L300V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFVKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 295 - protein, 415 aa, Homo sapiens
  FIX_K301N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLNFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 296 - protein, 415 aa, Homo sapiens
  FIX_K301Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLQFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 297 - protein, 415 aa, Homo sapiens
  FIX_F302I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKIGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 298 - protein, 415 aa, Homo sapiens
  FIX_F302V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKVGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 299 - protein, 415 aa, Homo sapiens
  FIX_Y306H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGHVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 300 - protein, 415 aa, Homo sapiens
  FIX_Y306I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGIVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 301 - protein, 415 aa, Homo sapiens
  FIX_W310S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGSGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 302 - protein, 415 aa, Homo sapiens
  FIX_W310H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGHGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 303 - protein, 415 aa, Homo sapiens
  FIX_R312H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGHVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 304 - protein, 415 aa, Homo sapiens
  FIX_R312Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGQVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 305 - protein, 415 aa, Homo sapiens
  FIX_F314I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVIHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 306 - protein, 415 aa, Homo sapiens
  FIX_F314V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVVHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 307 - protein, 415 aa, Homo sapiens
  FIX_K316N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHNGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 308 - protein, 415 aa, Homo sapiens
  FIX_K316Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHQGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 309 - protein, 415 aa, Homo sapiens
  FIX_R318H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGHSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 310 - protein, 415 aa, Homo sapiens
  FIX_R318Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGQSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 311 - protein, 415 aa, Homo sapiens
  FIX_L321I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSAIVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 312 - protein, 415 aa, Homo sapiens
  FIX_L321V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSAVVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 313 - protein, 415 aa, Homo sapiens
  FIX_L323I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVIQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 314 - protein, 415 aa, Homo sapiens
  FIX_L323V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVVQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 315 - protein, 415 aa, Homo sapiens
  FIX_Y325H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQHLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 316 - protein, 415 aa, Homo sapiens
  FIX_Y325I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQILRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 317 - protein, 415 aa, Homo sapiens
  FIX_L326I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYIRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 318 - protein, 415 aa, Homo sapiens
  FIX_L326V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYVRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 319 - protein, 415 aa, Homo sapiens
  FIX_R327H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLHVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 320 - protein, 415 aa, Homo sapiens
  FIX_R327Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLQVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 321 - protein, 415 aa, Homo sapiens
  FIX_P329A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVALVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 322 - protein, 415 aa, Homo sapiens
  FIX_P329S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVSLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 323 - protein, 415 aa, Homo sapiens
  FIX_L330I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPIVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 324 - protein, 415 aa, Homo sapiens
  FIX_L330V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPVVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 325 - protein, 415 aa, Homo sapiens
  FIX_D332N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVNRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 326 - protein, 415 aa, Homo sapiens
  FIX_D332Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVQRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 327 - protein, 415 aa, Homo sapiens
  FIX_R333H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDHATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 328 - protein, 415 aa, Homo sapiens
  FIX_R333Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDQATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 329 - protein, 415 aa, Homo sapiens
  FIX_L337I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCIRSTKFTIYNNMFCAGFHEGGRDSCQGDSGGPHVTEVEGTSFLTGIISWGEECAMKGKYGIYTKVSRYVNWIKEKTKLT

SEQ ID NO: 330 - protein, 415 aa, Homo sapiens
  FIX_L337V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCVRSTKFTIYNNMFCAGFHEGGRDSCQGDSGGPHVTEVEGTSFLTGIISWGEECAMKGKYGIYTKVSRYVNWIKEKTKLT

SEQ ID NO: 331 - protein, 415 aa, Homo sapiens
  FIX_R338H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLHSTKFTIYNNMFCAGFHEGGRDSCQGDSGGPHVTEVEGTSFLTGIISWGEECAMKGKYGIYTKVSRYVNWIKEKTKLT

SEQ ID NO: 332 - protein, 415 aa, Homo sapiens
  FIX_R338Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLQSTKFTIYNNMFCAGFHEGGRDSCQGDSGGPHVTEVEGTSFLTGIISWGEECAMKGKYGIYTKVSRYVNWIKEKTKLT

SEQ ID NO: 333 - protein, 415 aa, Homo sapiens
  FIX_K341N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTNFTIYNNMFCAGFHEGGRDSCQGDSGGPHVTEVEGTSFLTGIISWGEECAMKGKYGIYTKVSRYVNWIKEKTKLT

SEQ ID NO: 334 - protein, 415 aa, Homo sapiens
  FIX_K341Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTQFTIYNNMFCAGFHEGGRDSCQGDSGGPHVTEVEGTSFLTGIISWGEECAMKGKYGIYTKVSRYVNWIKEKTKLT

SEQ ID NO: 335 - protein, 415 aa, Homo sapiens
  FIX_F342I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKITIYNNMFCAGFHEGGRDSCQGDSGGPHVTEVEGTSFLTGIISWGEECAMKGKYGIYTKVSRYVNWIKEKTKLT

SEQ ID NO: 336 - protein, 415 aa, Homo sapiens
  FIX_F342V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKVTIYNNMFCAGFHEGGRDSCQGDSGGPHVTEVEGTSFLTGIISWGEECAMKGKYGIYTKVSRYVNWIKEKTKLT

SEQ ID NO: 337 - protein, 415 aa, Homo sapiens
  FIX_Y345H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIHNNMFCAGFHEGGRDSCQGDSGGPHVTEVEGTSFLTGIISWGEECAMKGKYGIYTKVSRYVNWIKEKTKLT

SEQ ID NO: 338 - protein, 415 aa, Homo sapiens
  FIX_Y345I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIINNMFCAGFHEGGRDSCQGDSGGPHVTEVEGTSFLTGIISWGEECAMKGKYGIYTKVSRYVNWIKEKTKLT

SEQ ID NO: 339 - protein, 415 aa, Homo sapiens
  FIX_M348I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNIFCAGFHEGGRDSCQGDSGGPHVTEVEGTSFLTGIISWGEECAMKGKYGIYTKVSRYVNWIKEKTKLT

SEQ ID NO: 340 - protein, 415 aa, Homo sapiens
  FIX_M348V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNVFCAGFHEGGRDSCQGDSGGPHVTEVEGTSFLTGIISWGEECAMKGKYGIYTKVSRYVNWIKEKTKLT

SEQ ID NO: 341 - protein, 415 aa, Homo sapiens
  FIX_F349I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMICAGFHEGGRDSCQGDSGGPHVTEVEGTSFLTGIISWGEECAMKGKYGIYTKVSRYVNWIKEKTKLT

SEQ ID NO: 342 - protein, 415 aa, Homo sapiens
  FIX_F349V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMVCAGFHEGGRDSCQGDSGGPHVTEVEGTSFLTGIISWGEECAMKGKYGIYTKVSRYVNWIKEKTKLT

SEQ ID NO: 343 - protein, 415 aa, Homo sapiens
  FIX_F353I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGIHEGGRDSCQGDSGGPHVTEVEGTSFLTGIISWGEECAMKGKYGIYTKVSRYVNWIKEKTKLT

SEQ ID NO: 344 - protein, 415 aa, Homo sapiens
  FIX_F353V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGVHEGGRDSCQGDSGGPHVTEVEGTSFLTGIISWGEECAMKGKYGIYTKVSRYVNWIKEKTKLT

SEQ ID NO: 345 - protein, 415 aa, Homo sapiens
  FIX_E355Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHQGGRDSCQGDSGGPHVTEVEGTSFLTGIISWGEECAMKGKYGIYTKVSRYVNWIKEKTKLT

SEQ ID NO: 346 - protein, 415 aa, Homo sapiens
  FIX_E355H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHHGGRDSCQGDSGGPHVTEVEGTSFLTGIISWGEECAMKGKYGIYTKVSRYVNWIKEKTKLT

SEQ ID NO: 347 - protein, 415 aa, Homo sapiens
  FIX_E355N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHNGGRDSCQGDSGGPHVTEVEGTSFLTGIISWGEECAMKGKYGIYTKVSRYVNWIKEKTKLT

SEQ ID NO: 348 - protein, 415 aa, Homo sapiens
  FIX_R358H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGHDSCQGDSGGPHVTEVEGTSFLTGIISWGEECAMKGKYGIYTKVSRYVNWIKEKTKLT

SEQ ID NO: 349 - protein, 415 aa, Homo sapiens
  FIX_R358Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGQDSCQGDSGGPHVTEVEGTSFLTGIISWGEECAMKGKYGIYTKVSRYVNWIKEKTKLT

SEQ ID NO: 350 - protein, 415 aa, Homo sapiens
  FIX_D359N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRNSCQGDSGGPHVTEVEGTSFLTGIISWGEECAMKGKYGIYTKVSRYVNWIKEKTKLT

SEQ ID NO: 351 - protein, 415 aa, Homo sapiens
  FIX_D359Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRQSCQGDSGGPHVTEVEGTSFLTGIISWGEECAMKGKYGIYTKVSRYVNWIKEKTKLT

SEQ ID NO: 352 - protein, 415 aa, Homo sapiens
  FIX_D364N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGNSGGPHVTEVEGTSFLTGIISWGEECAMKGKYGIYTKVSRYVNWIKEKTKLT

SEQ ID NO: 353 - protein, 415 aa, Homo sapiens
  FIX_D364Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGQSGGPHVTEVEGTSFLTGIISWGEECAMKGKYGIYTKVSRYVNWIKEKTKLT

SEQ ID NO: 354 - protein, 415 aa, Homo sapiens
  FIX_P368A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGAHVTEVEGTSFLTGIISWGEECAMKGKYGIYTKVSRYVNWIKEKTKLT

SEQ ID NO: 355 - protein, 415 aa, Homo sapiens
  FIX_P368S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGSHVTEVEGTSFLTGIISWGEECAMKGKYGIYTKVSRYVNWIKEKTKLT

SEQ ID NO: 356 - protein, 415 aa, Homo sapiens
  FIX_E372Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTQVEGTSFLTGIISWGEECAMKGKYGIYTKVSRYVNWIKEKTKLT

SEQ ID NO: 357 - protein, 415 aa, Homo sapiens
  FIX_E372H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTHVEGTSFLTGIISWGEECAMKGKYGIYTKVSRYVNWIKEKTKLT

SEQ ID NO: 358 - protein, 415 aa, Homo sapiens
  FIX_E372N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTNVEGTSFLTGIISWGEECAMKGKYGIYTKVSRYVNWIKEKTKLT

SEQ ID NO: 359 - protein, 415 aa, Homo sapiens
  FIX_E374Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVQGTSFLTGIISWGEECAMKGKYGIYTKVSRYVNWIKEKTKLT

SEQ ID NO: 360 - protein, 415 aa, Homo sapiens
  FIX_E374H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVHGTSFLTGIISWGEECAMKGKYGIYTKVSRYVNWIKEKTKLT

SEQ ID NO: 361 - protein, 415 aa, Homo sapiens
  FIX_E374N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVNGTSFLTGIISWGEECAMKGKYGIYTKVSRYVNWIKEKTKLT

SEQ ID NO: 362 - protein, 415 aa, Homo sapiens
  FIX_F378I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSILTGIISWGEECAMKGKYGIYTKVSRYVNWIKEKTKLT

SEQ ID NO: 363 - protein, 415 aa, Homo sapiens
  FIX_F378V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSVLTGIISWGEECAMKGKYGIYTKVSRYVNWIKEKTKLT

SEQ ID NO: 364 - protein, 415 aa, Homo sapiens
  FIX_L379I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFITGIISWGEECAMKGKYGIYTKVSRYVNWIKEKTKLT

SEQ ID NO: 365 - protein, 415 aa, Homo sapiens
  FIX_L379V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFVTGIISWGEECAMKGKYGIYTKVSRYVNWIKEKTKLT

SEQ ID NO: 366 - protein, 415 aa, Homo sapiens
  FIX_W385S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISSGEECAMKGKYGIYTKVSRYVNWIKEKTKLT

SEQ ID NO: 367 - protein, 415 aa, Homo sapiens
  FIX_W385H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISHGEECAMKGKYGIYTKVSRYVNWIKEKTKLT

SEQ ID NO: 368 - protein, 415 aa, Homo sapiens
  FIX_E387Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGQECAMKGKYGIYTKVSRYVNWIKEKTKLT

SEQ ID NO: 369 - protein, 415 aa, Homo sapiens
  FIX_E387H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGHECAMKGKYGIYTKVSRYVNWIKEKTKLT

SEQ ID NO: 370 - protein, 415 aa, Homo sapiens
  FIX_E387N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGNECAMKGKYGIYTKVSRYVNWIKEKTKLT

SEQ ID NO: 371 - protein, 415 aa, Homo sapiens
  FIX_E388Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEQCAMKGKYGIYTKVSRYVNWIKEKTKLT

SEQ ID NO: 372 - protein, 415 aa, Homo sapiens
  FIX_E388H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEHCAMKGKYGIYTKVSRYVNWIKEKTKLT

SEQ ID NO: 373 - protein, 415 aa, Homo sapiens
  FIX_E388N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGENCAMKGKYGIYTKVSRYVNWIKEKTKLT

SEQ ID NO: 374 - protein, 415 aa, Homo sapiens
  FIX_M391I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAIKGKYGIYTKVSRYVNWIKEKTKLT

SEQ ID NO: 375 - protein, 415 aa, Homo sapiens
  FIX_M391V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAVKGKYGIYTKVSRYVNWIKEKTKLT

SEQ ID NO: 376 - protein, 415 aa, Homo sapiens
  FIX_K392N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMNGKYGIYTKVSRYVNWIKEKTKLT

SEQ ID NO: 377 - protein, 415 aa, Homo sapiens
  FIX_K392Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMQGKYGIYTKVSRYVNWIKEKTKLT

SEQ ID NO: 378 - protein, 415 aa, Homo sapiens
  FIX_K394N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGNYGIYTKVSRYVNWIKEKTKLT

SEQ ID NO: 379 - protein, 415 aa, Homo sapiens
  FIX_K394Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGQYGIYTKVSRYVNWIKEKTKLT

SEQ ID NO: 380 - protein, 415 aa, Homo sapiens
  FIX_Y395H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKHGIYTKVSRYVNWIKEKTKLT

SEQ ID NO: 381 - protein, 415 aa, Homo sapiens
  FIX_Y395I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKIGIYTKVSRYVNWIKEKTKLT

SEQ ID NO: 382 - protein, 415 aa, Homo sapiens
  FIX_Y398H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIHTKVSRYVNWIKEKTKLT

SEQ ID NO: 383 - protein, 415 aa, Homo sapiens
  FIX_Y398I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIITKVSRYVNWIKEKTKLT

SEQ ID NO: 384 - protein, 415 aa, Homo sapiens
  FIX_K400N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTNVSRYVNWIKEKTKLT

SEQ ID NO: 385 - protein, 415 aa, Homo sapiens
  FIX_K400Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTQVSRYVNWIKEKTKLT

SEQ ID NO: 386 - protein, 415 aa, Homo sapiens
  FIX_R403H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSHYVNWIKEKTKLT

SEQ ID NO: 387 - protein, 415 aa, Homo sapiens
  FIX_R403Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSQYVNWIKEKTKLT

SEQ ID NO: 388 - protein, 415 aa, Homo sapiens
  FIX_Y404H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRHVNWIKEKTKLT

SEQ ID NO: 389 - protein, 415 aa, Homo sapiens
  FIX_Y404I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRIVNWIKEKTKLT

SEQ ID NO: 390 - protein, 415 aa, Homo sapiens
  FIX_W407S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNSIKEKTKLT

SEQ ID NO: 391 - protein, 415 aa, Homo sapiens
  FIX_W407H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNHIKEKTKLT

SEQ ID NO: 392 - protein, 415 aa, Homo sapiens
  FIX_K409N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWINEKTKLT

SEQ ID NO: 393 - protein, 415 aa, Homo sapiens
  FIX_K409Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIQEKTKLT

SEQ ID NO: 394 - protein, 415 aa, Homo sapiens
  FIX_E410Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKQKTKLT

SEQ ID NO: 395 - protein, 415 aa, Homo sapiens
  FIX_E410H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKHKTKLT

SEQ ID NO: 396 - protein, 415 aa, Homo sapiens
  FIX_E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKNKTKLT

SEQ ID NO: 397 - protein, 415 aa, Homo sapiens
  FIX_K411N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKENTKLT

SEQ ID NO: 398 - protein, 415 aa, Homo sapiens
  FIX_K411Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEQTKLT

SEQ ID NO: 399 - protein, 415 aa, Homo sapiens
  FIX_K413N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTNLT

SEQ ID NO: 400 - protein, 415 aa, Homo sapiens
  FIX_K413Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTQLT

SEQ ID NO: 401 - protein, 415 aa, Homo sapiens
  FIX_L414I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKIT

SEQ ID NO: 402 - protein, 415 aa, Homo sapiens
  FIX_L414V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKVT

SEQ ID NO: 403 - protein, 415 aa, Homo sapiens
  FIX_S3N
YNNGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 404 - protein, 415 aa, Homo sapiens
  FIX_S3Q
YNQGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 405 - protein, 415 aa, Homo sapiens
  FIX_S3H
YNHGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 406 - protein, 415 aa, Homo sapiens
  FIX_G4N
YNSNKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 407 - protein, 415 aa, Homo sapiens
  FIX_G4Q
YNSQKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 408 - protein, 415 aa, Homo sapiens
  FIX_G4H
YNSHKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 409 - protein, 415 aa, Homo sapiens
  FIX_V10N
YNSGKLEEFNQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 410 - protein, 415 aa, Homo sapiens
  FIX_V10Q
YNSGKLEEFQQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 411 - protein, 415 aa, Homo sapiens
  FIX_V10H
YNSGKLEEFHQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 412 - protein, 415 aa, Homo sapiens
  FIX_G12N
YNSGKLEEFVQNNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 413 - protein, 415 aa, Homo sapiens
  FIX_G12Q
YNSGKLEEFVQQNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 414 - protein, 415 aa, Homo sapiens
  FIX_G12H
YNSGKLEEFVQHNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 415 - protein, 415 aa, Homo sapiens
  FIX_S24N
YNSGKLEEFVQGNLERECMEEKCNFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 416 - protein, 415 aa, Homo sapiens
  FIX_S24Q
YNSGKLEEFVQGNLERECMEEKCQFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 417 - protein, 415 aa, Homo sapiens
  FIX_S24H
YNSGKLEEFVQGNLERECMEEKCHFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 418 - protein, 415 aa, Homo sapiens
  FIX_A28N
YNSGKLEEFVQGNLERECMEEKCSFEENREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 419 - protein, 415 aa, Homo sapiens
  FIX_A28Q
YNSGKLEEFVQGNLERECMEEKCSFEEQREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 420 - protein, 415 aa, Homo sapiens
  FIX_A28H
YNSGKLEEFVQGNLERECMEEKCSFEEHREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 421 - protein, 415 aa, Homo sapiens
  FIX_V31N
YNSGKLEEFVQGNLERECMEEKCSFEEARENFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 422 - protein, 415 aa, Homo sapiens
  FIX_V31Q
YNSGKLEEFVQGNLERECMEEKCSFEEAREQFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 423 - protein, 415 aa, Homo sapiens
  FIX_V31H
YNSGKLEEFVQGNLERECMEEKCSFEEAREHFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 424 - protein, 415 aa, Homo sapiens
  FIX_T35N
YNSGKLEEFVQGNLERECMEEKCSFEEAREVFENNERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 425 - protein, 415 aa, Homo sapiens
  FIX_T35Q
YNSGKLEEFVQGNLERECMEEKCSFEEAREVFENQERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 426 - protein, 415 aa, Homo sapiens
  FIX_T35H
YNSGKLEEFVQGNLERECMEEKCSFEEAREVFENHERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 427 - protein, 415 aa, Homo sapiens
  FIX_T38N
YNSGKLEEFVQGNLERECMEEKCSFEEAREVFENTERNTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 428 - protein, 415 aa, Homo sapiens
  FIX_T38Q
YNSGKLEEFVQGNLERECMEEKCSFEEAREVFENTERQTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 429 - protein, 415 aa, Homo sapiens
  FIX_T38H
YNSGKLEEFVQGNLERECMEEKCSFEEAREVFENTERHTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 430 - protein, 415 aa, Homo sapiens
  FIX_T39N
YNSGKLEEFVQGNLERECMEEKCSFEEAREVFENTERTNEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 431 - protein, 415 aa, Homo sapiens
  FIX_T39Q
YNSGKLEEFVQGNLERECMEEKCSFEEAREVFENTERTQEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 432 - protein, 415 aa, Homo sapiens
  FIX_T39H
YNSGKLEEFVQGNLERECMEEKCSFEEAREVFENTERTHEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 433 - protein, 415 aa, Homo sapiens
  FIX_V46N
YNSGKLEEFVQGNLERECMEEKCSFEEAREVFENTERTTEFWKQYNDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 434 - protein, 415 aa, Homo sapiens
  FIX_V46Q
YNSGKLEEFVQGNLERECMEEKCSFEEAREVFENTERTTEFWKQYQDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 435 - protein, 415 aa, Homo sapiens
  FIX_V46H
YNSGKLEEFVQGNLERECMEEKCSFEEAREVFENTERTTEFWKQYHDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 436 - protein, 415 aa, Homo sapiens
  FIX_G48N
YNSGKLEEFVQGNLERECMEEKCSFEEAREVFENTERTTEFWKQYVDNDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 437 - protein, 415 aa, Homo sapiens
  FIX_G48Q
YNSGKLEEFVQGNLERECMEEKCSFEEAREVFENTERTTEFWKQYVDQDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 438 - protein, 415 aa, Homo sapiens
  FIX_G48H
YNSGKLEEFVQGNLERECMEEKCSFEEAREVFENTERTTEFWKQYVDHDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 439 - protein, 415 aa, Homo sapiens
  FIX_S53N
YNSGKLEEFVQGNLERECMEEKCSFEEAREVFENTERTTEFWKQYVDGDQCENNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 440 - protein, 415 aa, Homo sapiens
  FIX_S53Q
YNSGKLEEFVQGNLERECMEEKCSFEEAREVFENTERTTEFWKQYVDGDQCEQNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 441 - protein, 415 aa, Homo sapiens
  FIX_S53H
YNSGKLEEFVQGNLERECMEEKCSFEEAREVFENTERTTEFWKQYVDGDQCEHNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 442 - protein, 415 aa, Homo sapiens
  FIX_G59N
YNSGKLEEFVQGNLERECMEEKCSFEEAREVFENTERTTEFWKQYVDGDQCESNPCLNNGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 443 - protein, 415 aa, Homo sapiens
  FIX_G59Q
YNSGKLEEFVQGNLERECMEEKCSFEEAREVFENTERTTEFWKQYVDGDQCESNPCLNQGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 444 - protein, 415 aa, Homo sapiens
  FIX_G59H
YNSGKLEEFVQGNLERECMEEKCSFEEAREVFENTERTTEFWKQYVDGDQCESNPCLNHGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 445 - protein, 415 aa, Homo sapiens
  FIX_G60N
YNSGKLEEFVQGNLERECMEEKCSFEEAREVFENTERTTEFWKQYVDGDQCESNPCLNGNSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 446 - protein, 415 aa, Homo sapiens
  FIX_G60Q
YNSGKLEEFVQGNLERECMEEKCSFEEAREVFENTERTTEFWKQYVDGDQCESNPCLNGQSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 447 - protein, 415 aa, Homo sapiens
  FIX_G60H
YNSGKLEEFVQGNLERECMEEKCSFEEAREVFENTERTTEFWKQYVDGDQCESNPCLNGHSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 448 - protein, 415 aa, Homo sapiens
  FIX_S61N
YNSGKLEEFVQGNLERECMEEKCSFEEAREVFENTERTTEFWKQYVDGDQCESNPCLNGGNCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 449 - protein, 415 aa, Homo sapiens
  FIX_S61Q
YNSGKLEEFVQGNLERECMEEKCSFEEAREVFENTERTTEFWKQYVDGDQCESNPCLNGGQCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 450 - protein, 415 aa, Homo sapiens
  FIX_S61H
YNSGKLEEFVQGNLERECMEEKCSFEEAREVFENTERTTEFWKQYVDGDQCESNPCLNGGHCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 451 - protein, 415 aa, Homo sapiens
  FIX_I66N
YNSGKLEEFVQGNLERECMEEKCSFEEAREVFENTERTTEFWKQYVDGDQCESNPCLNGGSCKDDNNSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 452 - protein, 415 aa, Homo sapiens
  FIX_I66Q
YNSGKLEEFVQGNLERECMEEKCSFEEAREVFENTERTTEFWKQYVDGDQCESNPCLNGGSCKDDQNSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 453 - protein, 415 aa, Homo sapiens
  FIX_I66H
YNSGKLEEFVQGNLERECMEEKCSFEEAREVFENTERTTEFWKQYVDGDQCESNPCLNGGSCKDDHNSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 454 - protein, 415 aa, Homo sapiens
  FIX_S68N
YNSGKLEEFVQGNLERECMEEKCSFEEAREVFENTERTTEFWKQYVDGDQCESNPCLNGGSCKDDINNYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 455 - protein, 415 aa, Homo sapiens
  FIX_S68Q
YNSGKLEEFVQGNLERECMEEKCSFEEAREVFENTERTTEFWKQYVDGDQCESNPCLNGGSCKDDINQYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 456 - protein, 415 aa, Homo sapiens
  FIX_S68H
YNSGKLEEFVQGNLERECMEEKCSFEEAREVFENTERTTEFWKQYVDGDQCESNPCLNGGSCKDDINHYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 457 - protein, 415 aa, Homo sapiens
  FIX_G76N
YNSGKLEEFVQGNLERECMEEKCSFEEAREVFENTERTTEFWKQYVDGDQCESNPCLNGGSCKDDINSYECWCPFNFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 458 - protein, 415 aa, Homo sapiens
  FIX_G76Q
YNSGKLEEFVQGNLERECMEEKCSFEEAREVFENTERTTEFWKQYVDGDQCESNPCLNGGSCKDDINSYECWCPFQFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 459 - protein, 415 aa, Homo sapiens
  FIX_G76H
YNSGKLEEFVQGNLERECMEEKCSFEEAREVFENTERTTEFWKQYVDGDQCESNPCLNGGSCKDDINSYECWCPFHFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 460 - protein, 415 aa, Homo sapiens
  FIX_G79N
YNSGKLEEFVQGNLERECMEEKCSFEEAREVFENTERTTEFWKQYVDGDQCESNPCLNGGSCKDDINSYECWCPFGFENKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 461 - protein, 415 aa, Homo sapiens
  FIX_G79Q
YNSGKLEEFVQGNLERECMEEKCSFEEAREVFENTERTTEFWKQYVDGDQCESNPCLNGGSCKDDINSYECWCPFGFEQKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 462 - protein, 415 aa, Homo sapiens
  FIX_G79H
YNSGKLEEFVQGNLERECMEEKCSFEEAREVFENTERTTEFWKQYVDGDQCESNPCLNGGSCKDDINSYECWCPFGFEHKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 463 - protein, 415 aa, Homo sapiens
  FIX_V86N
YNSGKLEEFVQGNLERECMEEKCSFEEAREVFENTERTTEFWKQYVDGDQCESNPCLNGGSCKDDINSYECWCPFGFEGKNCELDNTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 464 - protein, 415 aa, Homo sapiens
  FIX_V86Q
YNSGKLEEFVQGNLERECMEEKCSFEEAREVFENTERTTEFWKQYVDGDQCESNPCLNGGSCKDDINSYECWCPFGFEGKNCELDQTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 465 - protein, 415 aa, Homo sapiens
  FIX_V86H
YNSGKLEEFVQGNLERECMEEKCSFEEAREVFENTERTTEFWKQYVDGDQCESNPCLNGGSCKDDINSYECWCPFGFEGKNCELDHTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 466 - protein, 415 aa, Homo sapiens
  FIX_T87N
YNSGKLEEFVQGNLERECMEEKCSFEEAREVFENTERTTEFWKQYVDGDQCESNPCLNGGSCKDDINSYECWCPFGFEGKNCELDVNCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 467 - protein, 415 aa, Homo sapiens
  FIX_T87Q
YNSGKLEEFVQGNLERECMEEKCSFEEAREVFENTERTTEFWKQYVDGDQCESNPCLNGGSCKDDINSYECWCPFGFEGKNCELDVQCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 468 - protein, 415 aa, Homo sapiens
  FIX_T87H
YNSGKLEEFVQGNLERECMEEKCSFEEAREVFENTERTTEFWKQYVDGDQCESNPCLNGGSCKDDINSYECWCPFGFEGKNCELDVHCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 469 - protein, 415 aa, Homo sapiens
  FIX_I90N
YNSGKLEEFVQGNLERECMEEKCSFEEAREVFENTERTTEFWKQYVDGDQCESNPCLNGGSCKDDINSYECWCPFGFEGKNCELDVTCNNKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 470 - protein, 415 aa, Homo sapiens
  FIX_I90Q
YNSGKLEEFVQGNLERECMEEKCSFEEAREVFENTERTTEFWKQYVDGDQCESNPCLNGGSCKDDINSYECWCPFGFEGKNCELDVTCNQKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 471 - protein, 415 aa, Homo sapiens
  FIX_I90H
YNSGKLEEFVQGNLERECMEEKCSFEEAREVFENTERTTEFWKQYVDGDQCESNPCLNGGSCKDDINSYECWCPFGFEGKNCELDVTCNHKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 472 - protein, 415 aa, Homo sapiens
  FIX_G93N
YNSGKLEEFVQGNLERECMEEKCSFEEAREVFENTERTTEFWKQYVDGDQCESNPCLNGGSCKDDINSYECWCPFGFEGKNCELDVTCNIKNNRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 473 - protein, 415 aa, Homo sapiens
  FIX_G93Q
YNSGKLEEFVQGNLERECMEEKCSFEEAREVFENTERTTEFWKQYVDGDQCESNPCLNGGSCKDDINSYECWCPFGFEGKNCELDVTCNIKNQRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 474 - protein, 415 aa, Homo sapiens
  FIX_G93H
YNSGKLEEFVQGNLERECMEEKCSFEEAREVFENTERTTEFWKQYVDGDQCESNPCLNGGSCKDDINSYECWCPFGFEGKNCELDVTCNIKNHRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 475 - protein, 415 aa, Homo sapiens
  FIX_S102N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNNADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 476 - protein, 415 aa, Homo sapiens
  FIX_S102Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNQADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 477 - protein, 415 aa, Homo sapiens
  FIX_S102H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNHADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 478 - protein, 415 aa, Homo sapiens
  FIX_A103N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSNDNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 479 - protein, 415 aa, Homo sapiens
  FIX_A103Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSQDNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 480 - protein, 415 aa, Homo sapiens
  FIX_A103H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSHDNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 481 - protein, 415 aa, Homo sapiens
  FIX_V107N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKNVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 482 - protein, 415 aa, Homo sapiens
  FIX_V107Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKQVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 483 - protein, 415 aa, Homo sapiens
  FIX_V107H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKHVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 484 - protein, 415 aa, Homo sapiens
  FIX_V108N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVNCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 485 - protein, 415 aa, Homo sapiens
  FIX_V108Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVQCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 486 - protein, 415 aa, Homo sapiens
  FIX_V108H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVHCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 487 - protein, 415 aa, Homo sapiens
  FIX_S110N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCNCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 488 - protein, 415 aa, Homo sapiens
  FIX_S110Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCQCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 489 - protein, 415 aa, Homo sapiens
  FIX_S110H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCHCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 490 - protein, 415 aa, Homo sapiens
  FIX_T112N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCNEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 491 - protein, 415 aa, Homo sapiens
  FIX_T112Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCQEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 492 - protein, 415 aa, Homo sapiens
  FIX_T112H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCHEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 493 - protein, 415 aa, Homo sapiens
  FIX_G114N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTENYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 494 - protein, 415 aa, Homo sapiens
  FIX_G114Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEQYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 495 - protein, 415 aa, Homo sapiens
  FIX_G114H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEHYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 496 - protein, 415 aa, Homo sapiens
  FIX_A118N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLNENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 497 - protein, 415 aa, Homo sapiens
  FIX_A118Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLQENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 498 - protein, 415 aa, Homo sapiens
  FIX_A118H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLHENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 499 - protein, 415 aa, Homo sapiens
  FIX_S123N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKNCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 500 - protein, 415 aa, Homo sapiens
  FIX_S123Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKQCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 501 - protein, 415 aa, Homo sapiens
  FIX_S123H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKHCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 502 - protein, 415 aa, Homo sapiens
  FIX_A127N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPNVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 503 - protein, 415 aa, Homo sapiens
  FIX_A127Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPQVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 504 - protein, 415 aa, Homo sapiens
  FIX_A127H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPHVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 505 - protein, 415 aa, Homo sapiens
  FIX_V128N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPANPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 506 - protein, 415 aa, Homo sapiens
  FIX_V128Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAQPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 507 - protein, 415 aa, Homo sapiens
  FIX_V128H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAHPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 508 - protein, 415 aa, Homo sapiens
  FIX_G133N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCNRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 509 - protein, 415 aa, Homo sapiens
  FIX_G133Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCQRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 510 - protein, 415 aa, Homo sapiens
  FIX_G133H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCHRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 511 - protein, 415 aa, Homo sapiens
  FIX_V135N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRNSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 512 - protein, 415 aa, Homo sapiens
  FIX_V135Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRQSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 513 - protein, 415 aa, Homo sapiens
  FIX_V135H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRHSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 514 - protein, 415 aa, Homo sapiens
  FIX_S136N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVNVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 515 - protein, 415 aa, Homo sapiens
  FIX_S136Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVQVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 516 - protein, 415 aa, Homo sapiens
  FIX_S136H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVHVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 517 - protein, 415 aa, Homo sapiens
  FIX_V137N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSNSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 518 - protein, 415 aa, Homo sapiens
  FIX_V137Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSQSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 519 - protein, 415 aa, Homo sapiens
  FIX_V137H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSHSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 520 - protein, 415 aa, Homo sapiens
  FIX_S138N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVNQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 521 - protein, 415 aa, Homo sapiens
  FIX_S138Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVQQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 522 - protein, 415 aa, Homo sapiens
  FIX_S138H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVHQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 523 - protein, 415 aa, Homo sapiens
  FIX_T140N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQNSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 524 - protein, 415 aa, Homo sapiens
  FIX_T140Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQQSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 525 - protein, 415 aa, Homo sapiens
  FIX_T140H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQHSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 526 - protein, 415 aa, Homo sapiens
  FIX_S141N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTNKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 527 - protein, 415 aa, Homo sapiens
  FIX_S141Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTQKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 528 - protein, 415 aa, Homo sapiens
  FIX_S141H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTHKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 529 - protein, 415 aa, Homo sapiens
  FIX_T144N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLNRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 530 - protein, 415 aa, Homo sapiens
  FIX_T144Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLQRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 531 - protein, 415 aa, Homo sapiens
  FIX_T144H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLHRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 532 - protein, 415 aa, Homo sapiens
  FIX_A146N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRNETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 533 - protein, 415 aa, Homo sapiens
  FIX_A146Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRQETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 534 - protein, 415 aa, Homo sapiens
  FIX_A146H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRHETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 535 - protein, 415 aa, Homo sapiens
  FIX_T148N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAENVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 536 - protein, 415 aa, Homo sapiens
  FIX_T148Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEQVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 537 - protein, 415 aa, Homo sapiens
  FIX_T148H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEHVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 538 - protein, 415 aa, Homo sapiens
  FIX_V149N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETNFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 539 - protein, 415 aa, Homo sapiens
  FIX_V149Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETQFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 540 - protein, 415 aa, Homo sapiens
  FIX_V149H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETHFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 541 - protein, 415 aa, Homo sapiens
  FIX_V153N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDNDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 542 - protein, 415 aa, Homo sapiens
  FIX_V153Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDQDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 543 - protein, 415 aa, Homo sapiens
  FIX_V153H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDHDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 544 - protein, 415 aa, Homo sapiens
  FIX_V156N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYNNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 545 - protein, 415 aa, Homo sapiens
  FIX_V156Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYQNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 546 - protein, 415 aa, Homo sapiens
  FIX_V156H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYHNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 547 - protein, 415 aa, Homo sapiens
  FIX_S158N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNNTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 548 - protein, 415 aa, Homo sapiens
  FIX_S158Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNQTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 549 - protein, 415 aa, Homo sapiens
  FIX_S158H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNHTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 550 - protein, 415 aa, Homo sapiens
  FIX_T159N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSNEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 551 - protein, 415 aa, Homo sapiens
  FIX_T159Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSQEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 552 - protein, 415 aa, Homo sapiens
  FIX_T159H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSHEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 553 - protein, 415 aa, Homo sapiens
  FIX_A161N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTENETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 554 - protein, 415 aa, Homo sapiens
  FIX_A161Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEQETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 555 - protein, 415 aa, Homo sapiens
  FIX_A161H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEHETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 556 - protein, 415 aa, Homo sapiens
  FIX_T163N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 557 - protein, 415 aa, Homo sapiens
  FIX_T163Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEQILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 558 - protein, 415 aa, Homo sapiens
  FIX_T163H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 559 - protein, 415 aa, Homo sapiens
  FIX_I164N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETNLDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 560 - protein, 415 aa, Homo sapiens
  FIX_I164Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 561 - protein, 415 aa, Homo sapiens
  FIX_I164H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETHLDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 562 - protein, 415 aa, Homo sapiens
  FIX_I168N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNNTQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 563 - protein, 415 aa, Homo sapiens
  FIX_I168Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNQTQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 564 - protein, 415 aa, Homo sapiens
  FIX_I168H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNHTQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 565 - protein, 415 aa, Homo sapiens
  FIX_T169N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNINQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 566 - protein, 415 aa, Homo sapiens
  FIX_T169Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIQQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 567 - protein, 415 aa, Homo sapiens
  FIX_T169H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 568 - protein, 415 aa, Homo sapiens
  FIX_S171N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQNTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 569 - protein, 415 aa, Homo sapiens
  FIX_S171Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 570 - protein, 415 aa, Homo sapiens
  FIX_S171H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQHTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 571 - protein, 415 aa, Homo sapiens
  FIX_T172N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSNQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 572 - protein, 415 aa, Homo sapiens
  FIX_T172Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSQQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 573 - protein, 415 aa, Homo sapiens
  FIX_T172H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSHQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 574 - protein, 415 aa, Homo sapiens
  FIX_S174N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQNFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 575 - protein, 415 aa, Homo sapiens
  FIX_S174Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 576 - protein, 415 aa, Homo sapiens
  FIX_S174H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 577 - protein, 415 aa, Homo sapiens
  FIX_T179N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFNRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 578 - protein, 415 aa, Homo sapiens
  FIX_T179Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 579 - protein, 415 aa, Homo sapiens
  FIX_T179H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 580 - protein, 415 aa, Homo sapiens
  FIX_V181N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRNVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 581 - protein, 415 aa, Homo sapiens
  FIX_V181Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRQVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 582 - protein, 415 aa, Homo sapiens
  FIX_V181H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRHVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 583 - protein, 415 aa, Homo sapiens
  FIX_V182N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVNGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 584 - protein, 415 aa, Homo sapiens
  FIX_V182Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVQGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 585 - protein, 415 aa, Homo sapiens
  FIX_V182H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVHGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 586 - protein, 415 aa, Homo sapiens
  FIX_G183N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVNGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 587 - protein, 415 aa, Homo sapiens
  FIX_G183Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVQGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 588 - protein, 415 aa, Homo sapiens
  FIX_G183H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVHGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 589 - protein, 415 aa, Homo sapiens
  FIX_G184N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGNEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 590 - protein, 415 aa, Homo sapiens
  FIX_G184Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGQEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 591 - protein, 415 aa, Homo sapiens
  FIX_G184H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGHEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 592 - protein, 415 aa, Homo sapiens
  FIX_A187N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDNKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 593 - protein, 415 aa, Homo sapiens
  FIX_A187Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDQKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 594 - protein, 415 aa, Homo sapiens
  FIX_A187H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDHKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 595 - protein, 415 aa, Homo sapiens
  FIX_G190N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPNQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 596 - protein, 415 aa, Homo sapiens
  FIX_G190Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPQQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 597 - protein, 415 aa, Homo sapiens
  FIX_G190H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPHQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 598 - protein, 415 aa, Homo sapiens
  FIX_V196N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQNVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 599 - protein, 415 aa, Homo sapiens
  FIX_V196Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQQVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 600 - protein, 415 aa, Homo sapiens
  FIX_V196H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQHVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 601 - protein, 415 aa, Homo sapiens
  FIX_V197N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVNLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 602 - protein, 415 aa, Homo sapiens
  FIX_V197Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVQLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 603 - protein, 415 aa, Homo sapiens
  FIX_V197H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVHLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 604 - protein, 415 aa, Homo sapiens
  FIX_G200N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNNKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 605 - protein, 415 aa, Homo sapiens
  FIX_G200Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNQKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 606 - protein, 415 aa, Homo sapiens
  FIX_G200H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNHKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 607 - protein, 415 aa, Homo sapiens
  FIX_V202N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKNDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 608 - protein, 415 aa, Homo sapiens
  FIX_V202Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKQDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 609 - protein, 415 aa, Homo sapiens
  FIX_V202H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKHDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 610 - protein, 415 aa, Homo sapiens
  FIX_A204N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDNFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 611 - protein, 415 aa, Homo sapiens
  FIX_A204Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDQFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 612 - protein, 415 aa, Homo sapiens
  FIX_A204H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDHFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 613 - protein, 415 aa, Homo sapiens
  FIX_G207N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCNGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 614 - protein, 415 aa, Homo sapiens
  FIX_G207Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCQGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 615 - protein, 415 aa, Homo sapiens
  FIX_G207H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCHGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 616 - protein, 415 aa, Homo sapiens
  FIX_G208N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGNSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 617 - protein, 415 aa, Homo sapiens
  FIX_G208Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGQSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 618 - protein, 415 aa, Homo sapiens
  FIX_G208H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGHSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 619 - protein, 415 aa, Homo sapiens
  FIX_S209N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGNIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 620 - protein, 415 aa, Homo sapiens
  FIX_S209Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGQIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 621 - protein, 415 aa, Homo sapiens
  FIX_S209H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGHIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 622 - protein, 415 aa, Homo sapiens
  FIX_I210N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSNVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 623 - protein, 415 aa, Homo sapiens
  FIX_I210Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSQVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 624 - protein, 415 aa, Homo sapiens
  FIX_I210H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSHVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 625 - protein, 415 aa, Homo sapiens
  FIX_V211N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSINNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 626 - protein, 415 aa, Homo sapiens
  FIX_V211Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIQNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 627 - protein, 415 aa, Homo sapiens
  FIX_V211H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIHNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 628 - protein, 415 aa, Homo sapiens
  FIX_I216N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWNVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 629 - protein, 415 aa, Homo sapiens
  FIX_I216Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWQVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 630 - protein, 415 aa, Homo sapiens
  FIX_I216H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWHVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 631 - protein, 415 aa, Homo sapiens
  FIX_V217N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWINTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 632 - protein, 415 aa, Homo sapiens
  FIX_V217Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIQTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 633 - protein, 415 aa, Homo sapiens
  FIX_V217H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIHTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 634 - protein, 415 aa, Homo sapiens
  FIX_T218N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVNAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 635 - protein, 415 aa, Homo sapiens
  FIX_T218Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVQAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 636 - protein, 415 aa, Homo sapiens
  FIX_T218H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVHAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 637 - protein, 415 aa, Homo sapiens
  FIX_A219N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTNAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 638 - protein, 415 aa, Homo sapiens
  FIX_A219Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTQAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 639 - protein, 415 aa, Homo sapiens
  FIX_A219H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTHAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 640 - protein, 415 aa, Homo sapiens
  FIX_A220N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTANHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 641 - protein, 415 aa, Homo sapiens
  FIX_A220Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAQHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 642 - protein, 415 aa, Homo sapiens
  FIX_A220H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAHHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 643 - protein, 415 aa, Homo sapiens
  FIX_V223N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCNETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 644 - protein, 415 aa, Homo sapiens
  FIX_V223Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCQETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 645 - protein, 415 aa, Homo sapiens
  FIX_V223H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCHETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 646 - protein, 415 aa, Homo sapiens
  FIX_T225N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVENGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 647 - protein, 415 aa, Homo sapiens
  FIX_T225Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEQGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 648 - protein, 415 aa, Homo sapiens
  FIX_T225H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEHGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 649 - protein, 415 aa, Homo sapiens
  FIX_G226N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETNVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 650 - protein, 415 aa, Homo sapiens
  FIX_G226Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETQVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 651 - protein, 415 aa, Homo sapiens
  FIX_G226H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETHVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 652 - protein, 415 aa, Homo sapiens
  FIX_V227N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGNKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 653 - protein, 415 aa, Homo sapiens
  FIX_V227Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGQKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 654 - protein, 415 aa, Homo sapiens
  FIX_V227H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGHKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 655 - protein, 415 aa, Homo sapiens
  FIX_I229N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKNTVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 656 - protein, 415 aa, Homo sapiens
  FIX_I229Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKQTVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 657 - protein, 415 aa, Homo sapiens
  FIX_I229H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKHTVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 658 - protein, 415 aa, Homo sapiens
  FIX_T230N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKINVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 659 - protein, 415 aa, Homo sapiens
  FIX_T230Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKIQVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 660 - protein, 415 aa, Homo sapiens
  FIX_T230H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKIHVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 661 - protein, 415 aa, Homo sapiens
  FIX_V231N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITNVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 662 - protein, 415 aa, Homo sapiens
  FIX_V231Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITQVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 663 - protein, 415 aa, Homo sapiens
  FIX_V231H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITHVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 664 - protein, 415 aa, Homo sapiens
  FIX_V232N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVNAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 665 - protein, 415 aa, Homo sapiens
  FIX_V232Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVQAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 666 - protein, 415 aa, Homo sapiens
  FIX_V232H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVHAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 667 - protein, 415 aa, Homo sapiens
  FIX_A233N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVNGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 668 - protein, 415 aa, Homo sapiens
  FIX_A233Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVQGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 669 - protein, 415 aa, Homo sapiens
  FIX_A233H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVHGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 670 - protein, 415 aa, Homo sapiens
  FIX_G234N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVANEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 671 - protein, 415 aa, Homo sapiens
  FIX_G234Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAQEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 672 - protein, 415 aa, Homo sapiens
  FIX_G234H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAHEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 673 - protein, 415 aa, Homo sapiens
  FIX_I238N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNNEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 674 - protein, 415 aa, Homo sapiens
  FIX_I238Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNQEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 675 - protein, 415 aa, Homo sapiens
  FIX_I238H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNHEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 676 - protein, 415 aa, Homo sapiens
  FIX_T241N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEENEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 677 - protein, 415 aa, Homo sapiens
  FIX_T241Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEEQEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 678 - protein, 415 aa, Homo sapiens
  FIX_T241H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEEHEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 679 - protein, 415 aa, Homo sapiens
  FIX_T244N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHNEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 680 - protein, 415 aa, Homo sapiens
  FIX_T244Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHQEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 681 - protein, 415 aa, Homo sapiens
  FIX_T244H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHHEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 682 - protein, 415 aa, Homo sapiens
  FIX_V250N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNNIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 683 - protein, 415 aa, Homo sapiens
  FIX_V250Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNQIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 684 - protein, 415 aa, Homo sapiens
  FIX_V250H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNHIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 685 - protein, 415 aa, Homo sapiens
  FIX_I251N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVNRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 686 - protein, 415 aa, Homo sapiens
  FIX_I251Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVQRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 687 - protein, 415 aa, Homo sapiens
  FIX_I251H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVHRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 688 - protein, 415 aa, Homo sapiens
  FIX_I253N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRNIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 689 - protein, 415 aa, Homo sapiens
  FIX_I253Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRQIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 690 - protein, 415 aa, Homo sapiens
  FIX_I253H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRHIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 691 - protein, 415 aa, Homo sapiens
  FIX_I254N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRINPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 692 - protein, 415 aa, Homo sapiens
  FIX_I254Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIQPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 693 - protein, 415 aa, Homo sapiens
  FIX_I254H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIHPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 694 - protein, 415 aa, Homo sapiens
  FIX_A261N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNNAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 695 - protein, 415 aa, Homo sapiens
  FIX_A261Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNQAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 696 - protein, 415 aa, Homo sapiens
  FIX_A261H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNHAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 697 - protein, 415 aa, Homo sapiens
  FIX_A262N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNANINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 698 - protein, 415 aa, Homo sapiens
  FIX_A262Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAQINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 699 - protein, 415 aa, Homo sapiens
  FIX_A262H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAHINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 700 - protein, 415 aa, Homo sapiens
  FIX_I263N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAANNKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 701 - protein, 415 aa, Homo sapiens
  FIX_I263Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAQNKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 702 - protein, 415 aa, Homo sapiens
  FIX_I263H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAHNKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 703 - protein, 415 aa, Homo sapiens
  FIX_I270N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDNALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 704 - protein, 415 aa, Homo sapiens
  FIX_I270Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDQALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 705 - protein, 415 aa, Homo sapiens
  FIX_I270H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDHALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 706 - protein, 415 aa, Homo sapiens
  FIX_A271N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDINLLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 707 - protein, 415 aa, Homo sapiens
  FIX_A271Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIQLLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 708 - protein, 415 aa, Homo sapiens
  FIX_A271H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIHLLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 709 - protein, 415 aa, Homo sapiens
  FIX_V280N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLNLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 710 - protein, 415 aa, Homo sapiens
  FIX_V280Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLQLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 711 - protein, 415 aa, Homo sapiens
  FIX_V280H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLHLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 712 - protein, 415 aa, Homo sapiens
  FIX_S283N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNNYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 713 - protein, 415 aa, Homo sapiens
  FIX_S283Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNQYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 714 - protein, 415 aa, Homo sapiens
  FIX_S283H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNHYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 715 - protein, 415 aa, Homo sapiens
  FIX_V285N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYNTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 716 - protein, 415 aa, Homo sapiens
  FIX_V285Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYQTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 717 - protein, 415 aa, Homo sapiens
  FIX_V285H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYHTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 718 - protein, 415 aa, Homo sapiens
  FIX_T286N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVNPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 719 - protein, 415 aa, Homo sapiens
  FIX_T286Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVQPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 720 - protein, 415 aa, Homo sapiens
  FIX_T286H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVHPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 721 - protein, 415 aa, Homo sapiens
  FIX_I288N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPNCIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 722 - protein, 415 aa, Homo sapiens
  FIX_I288Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPQCIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 723 - protein, 415 aa, Homo sapiens
  FIX_I288H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPHCIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 724 - protein, 415 aa, Homo sapiens
  FIX_I290N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICNADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 725 - protein, 415 aa, Homo sapiens
  FIX_I290Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICQADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 726 - protein, 415 aa, Homo sapiens
  FIX_I290H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICHADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 727 - protein, 415 aa, Homo sapiens
  FIX_A291N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICINDKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 728 - protein, 415 aa, Homo sapiens
  FIX_A291Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIQDKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 729 - protein, 415 aa, Homo sapiens
  FIX_A291H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIHDKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 730 - protein, 415 aa, Homo sapiens
  FIX_T296N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYNNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 731 - protein, 415 aa, Homo sapiens
  FIX_T296Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYQNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 732 - protein, 415 aa, Homo sapiens
  FIX_T296H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYHNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 733 - protein, 415 aa, Homo sapiens
  FIX_I298N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNNFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 734 - protein, 415 aa, Homo sapiens
  FIX_I298Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNQFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 735 - protein, 415 aa, Homo sapiens
  FIX_I298H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNHFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 736 - protein, 415 aa, Homo sapiens
  FIX_G303N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFNSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 737 - protein, 415 aa, Homo sapiens
  FIX_G303Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFQSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 738 - protein, 415 aa, Homo sapiens
  FIX_G303H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFHSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 739 - protein, 415 aa, Homo sapiens
  FIX_S304N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGNGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 740 - protein, 415 aa, Homo sapiens
  FIX_S304Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGQGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 741 - protein, 415 aa, Homo sapiens
  FIX_S304H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGHGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 742 - protein, 415 aa, Homo sapiens
  FIX_G305N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSNYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 743 - protein, 415 aa, Homo sapiens
  FIX_G305Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSQYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 744 - protein, 415 aa, Homo sapiens
  FIX_G305H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSHYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 745 - protein, 415 aa, Homo sapiens
  FIX_V307N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYNSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 746 - protein, 415 aa, Homo sapiens
  FIX_V307Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYQSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 747 - protein, 415 aa, Homo sapiens
  FIX_V307H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYHSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 748 - protein, 415 aa, Homo sapiens
  FIX_S308N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVNGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 749 - protein, 415 aa, Homo sapiens
  FIX_S308Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVQGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 750 - protein, 415 aa, Homo sapiens
  FIX_S308H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVHGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 751 - protein, 415 aa, Homo sapiens
  FIX_G309N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSNWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 752 - protein, 415 aa, Homo sapiens
  FIX_G309Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSQWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 753 - protein, 415 aa, Homo sapiens
  FIX_G309H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSHWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 754 - protein, 415 aa, Homo sapiens
  FIX_G311N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWNRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 755 - protein, 415 aa, Homo sapiens
  FIX_G311Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWQRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 756 - protein, 415 aa, Homo sapiens
  FIX_G311H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWHRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 757 - protein, 415 aa, Homo sapiens
  FIX_V313N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRNFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 758 - protein, 415 aa, Homo sapiens
  FIX_V313Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRQFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 759 - protein, 415 aa, Homo sapiens
  FIX_V313H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRHFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 760 - protein, 415 aa, Homo sapiens
  FIX_G317N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKNRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 761 - protein, 415 aa, Homo sapiens
  FIX_G317Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKQRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 762 - protein, 415 aa, Homo sapiens
  FIX_G317H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKHRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 763 - protein, 415 aa, Homo sapiens
  FIX_S319N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRNALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 764 - protein, 415 aa, Homo sapiens
  FIX_S319Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRQALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 765 - protein, 415 aa, Homo sapiens
  FIX_S319H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRHALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 766 - protein, 415 aa, Homo sapiens
  FIX_A320N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSNLVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 767 - protein, 415 aa, Homo sapiens
  FIX_A320Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSQLVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 768 - protein, 415 aa, Homo sapiens
  FIX_A320H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSHLVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 769 - protein, 415 aa, Homo sapiens
  FIX_V322N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALNLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 770 - protein, 415 aa, Homo sapiens
  FIX_V322Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALQLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 771 - protein, 415 aa, Homo sapiens
  FIX_V322H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALHLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 772 - protein, 415 aa, Homo sapiens
  FIX_V328N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRNPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 773 - protein, 415 aa, Homo sapiens
  FIX_V328Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRQPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 774 - protein, 415 aa, Homo sapiens
  FIX_V328H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRHPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 775 - protein, 415 aa, Homo sapiens
  FIX_V331N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLNDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 776 - protein, 415 aa, Homo sapiens
  FIX_V331Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLQDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 777 - protein, 415 aa, Homo sapiens
  FIX_V331H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLHDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 778 - protein, 415 aa, Homo sapiens
  FIX_A334N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRNTCLRSTKFTIYNNMFCAGFHEGGRDSCQGDSGGPHVTEVEGTSFLTGIISWGEECAMKGKYGIYTKVSRYVNWIKEKTKLT

SEQ ID NO: 779 - protein, 415 aa, Homo sapiens
  FIX_A334Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRQTCLRSTKFTIYNNMFCAGFHEGGRDSCQGDSGGPHVTEVEGTSFLTGIISWGEECAMKGKYGIYTKVSRYVNWIKEKTKLT

SEQ ID NO: 780 - protein, 415 aa, Homo sapiens
  FIX_A334H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRHTCLRSTKFTIYNNMFCAGFHEGGRDSCQGDSGGPHVTEVEGTSFLTGIISWGEECAMKGKYGIYTKVSRYVNWIKEKTKLT

SEQ ID NO: 781 - protein, 415 aa, Homo sapiens
  FIX_T335N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRANCLRSTKFTIYNNMFCAGFHEGGRDSCQGDSGGPHVTEVEGTSFLTGIISWGEECAMKGKYGIYTKVSRYVNWIKEKTKLT

SEQ ID NO: 782 - protein, 415 aa, Homo sapiens
  FIX_T335Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRAQCLRSTKFTIYNNMFCAGFHEGGRDSCQGDSGGPHVTEVEGTSFLTGIISWGEECAMKGKYGIYTKVSRYVNWIKEKTKLT

SEQ ID NO: 783 - protein, 415 aa, Homo sapiens
  FIX_T335H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRAHCLRSTKFTIYNNMFCAGFHEGGRDSCQGDSGGPHVTEVEGTSFLTGIISWGEECAMKGKYGIYTKVSRYVNWIKEKTKLT

SEQ ID NO: 784 - protein, 415 aa, Homo sapiens
  FIX_S339N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRNTKFTIYNNMFCAGFHEGGRDSCQGDSGGPHVTEVEGTSFLTGIISWGEECAMKGKYGIYTKVSRYVNWIKEKTKLT

SEQ ID NO: 785 - protein, 415 aa, Homo sapiens
  FIX_S339Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRQTKFTIYNNMFCAGFHEGGRDSCQGDSGGPHVTEVEGTSFLTGIISWGEECAMKGKYGIYTKVSRYVNWIKEKTKLT

SEQ ID NO: 786 - protein, 415 aa, Homo sapiens
  FIX_S339H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRHTKFTIYNNMFCAGFHEGGRDSCQGDSGGPHVTEVEGTSFLTGIISWGEECAMKGKYGIYTKVSRYVNWIKEKTKLT

SEQ ID NO: 787 - protein, 415 aa, Homo sapiens
  FIX_T340N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSNKFTIYNNMFCAGFHEGGRDSCQGDSGGPHVTEVEGTSFLTGIISWGEECAMKGKYGIYTKVSRYVNWIKEKTKLT

SEQ ID NO: 788 - protein, 415 aa, Homo sapiens
  FIX_T340Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSQKFTIYNNMFCAGFHEGGRDSCQGDSGGPHVTEVEGTSFLTGIISWGEECAMKGKYGIYTKVSRYVNWIKEKTKLT

SEQ ID NO: 789 - protein, 415 aa, Homo sapiens
  FIX_T340H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSHKFTIYNNMFCAGFHEGGRDSCQGDSGGPHVTEVEGTSFLTGIISWGEECAMKGKYGIYTKVSRYVNWIKEKTKLT

SEQ ID NO: 790 - protein, 415 aa, Homo sapiens
  FIX_T343N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFNIYNNMFCAGFHEGGRDSCQGDSGGPHVTEVEGTSFLTGIISWGEECAMKGKYGIYTKVSRYVNWIKEKTKLT

SEQ ID NO: 791 - protein, 415 aa, Homo sapiens
  FIX_T343Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFQIYNNMFCAGFHEGGRDSCQGDSGGPHVTEVEGTSFLTGIISWGEECAMKGKYGIYTKVSRYVNWIKEKTKLT

SEQ ID NO: 792 - protein, 415 aa, Homo sapiens
  FIX_T343H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFHIYNNMFCAGFHEGGRDSCQGDSGGPHVTEVEGTSFLTGIISWGEECAMKGKYGIYTKVSRYVNWIKEKTKLT

SEQ ID NO: 793 - protein, 415 aa, Homo sapiens
  FIX_I344N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTNYNNMFCAGFHEGGRDSCQGDSGGPHVTEVEGTSFLTGIISWGEECAMKGKYGIYTKVSRYVNWIKEKTKLT

SEQ ID NO: 794 - protein, 415 aa, Homo sapiens
  FIX_I344Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTQYNNMFCAGFHEGGRDSCQGDSGGPHVTEVEGTSFLTGIISWGEECAMKGKYGIYTKVSRYVNWIKEKTKLT

SEQ ID NO: 795 - protein, 415 aa, Homo sapiens
  FIX_I344H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTHYNNMFCAGFHEGGRDSCQGDSGGPHVTEVEGTSFLTGIISWGEECAMKGKYGIYTKVSRYVNWIKEKTKLT

SEQ ID NO: 796 - protein, 415 aa, Homo sapiens
  FIX_A351N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCNGFHEGGRDSCQGDSGGPHVTEVEGTSFLTGIISWGEECAMKGKYGIYTKVSRYVNWIKEKTKLT

SEQ ID NO: 797 - protein, 415 aa, Homo sapiens
  FIX_A351Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCQGFHEGGRDSCQGDSGGPHVTEVEGTSFLTGIISWGEECAMKGKYGIYTKVSRYVNWIKEKTKLT

SEQ ID NO: 798 - protein, 415 aa, Homo sapiens
  FIX_A351H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCHGFHEGGRDSCQGDSGGPHVTEVEGTSFLTGIISWGEECAMKGKYGIYTKVSRYVNWIKEKTKLT

SEQ ID NO: 799 - protein, 415 aa, Homo sapiens
  FIX_G352N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCANFHEGGRDSCQGDSGGPHVTEVEGTSFLTGIISWGEECAMKGKYGIYTKVSRYVNWIKEKTKLT

SEQ ID NO: 800 - protein, 415 aa, Homo sapiens
  FIX_G352Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAQFHEGGRDSCQGDSGGPHVTEVEGTSFLTGIISWGEECAMKGKYGIYTKVSRYVNWIKEKTKLT

SEQ ID NO: 801 - protein, 415 aa, Homo sapiens
  FIX_G352H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAHFHEGGRDSCQGDSGGPHVTEVEGTSFLTGIISWGEECAMKGKYGIYTKVSRYVNWIKEKTKLT

SEQ ID NO: 802 - protein, 415 aa, Homo sapiens
  FIX_G356N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHENGRDSCQGDSGGPHVTEVEGTSFLTGIISWGEECAMKGKYGIYTKVSRYVNWIKEKTKLT

SEQ ID NO: 803 - protein, 415 aa, Homo sapiens
  FIX_G356Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEQGRDSCQGDSGGPHVTEVEGTSFLTGIISWGEECAMKGKYGIYTKVSRYVNWIKEKTKLT

SEQ ID NO: 804 - protein, 415 aa, Homo sapiens
  FIX_G356H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEHGRDSCQGDSGGPHVTEVEGTSFLTGIISWGEECAMKGKYGIYTKVSRYVNWIKEKTKLT

SEQ ID NO: 805 - protein, 415 aa, Homo sapiens
  FIX_G357N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGNRDSCQGDSGGPHVTEVEGTSFLTGIISWGEECAMKGKYGIYTKVSRYVNWIKEKTKLT

SEQ ID NO: 806 - protein, 415 aa, Homo sapiens
  FIX_G357Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGQRDSCQGDSGGPHVTEVEGTSFLTGIISWGEECAMKGKYGIYTKVSRYVNWIKEKTKLT

SEQ ID NO: 807 - protein, 415 aa, Homo sapiens
  FIX_G357H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGHRDSCQGDSGGPHVTEVEGTSFLTGIISWGEECAMKGKYGIYTKVSRYVNWIKEKTKLT

SEQ ID NO: 808 - protein, 415 aa, Homo sapiens
  FIX_S360N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDNCQGDSGGPHVTEVEGTSFLTGIISWGEECAMKGKYGIYTKVSRYVNWIKEKTKLT

SEQ ID NO: 809 - protein, 415 aa, Homo sapiens
  FIX_S360Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDQCQGDSGGPHVTEVEGTSFLTGIISWGEECAMKGKYGIYTKVSRYVNWIKEKTKLT

SEQ ID NO: 810 - protein, 415 aa, Homo sapiens
  FIX_S360H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDHCQGDSGGPHVTEVEGTSFLTGIISWGEECAMKGKYGIYTKVSRYVNWIKEKTKLT

SEQ ID NO: 811 - protein, 415 aa, Homo sapiens
  FIX_G363N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQNDSGGPHVTEVEGTSFLTGIISWGEECAMKGKYGIYTKVSRYVNWIKEKTKLT

SEQ ID NO: 812 - protein, 415 aa, Homo sapiens
  FIX_G363Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQQDSGGPHVTEVEGTSFLTGIISWGEECAMKGKYGIYTKVSRYVNWIKEKTKLT

SEQ ID NO: 813 - protein, 415 aa, Homo sapiens
  FIX_G363H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQHDSGGPHVTEVEGTSFLTGIISWGEECAMKGKYGIYTKVSRYVNWIKEKTKLT

SEQ ID NO: 814 - protein, 415 aa, Homo sapiens
  FIX_S365N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDNGGPHVTEVEGTSFLTGIISWGEECAMKGKYGIYTKVSRYVNWIKEKTKLT

SEQ ID NO: 815 - protein, 415 aa, Homo sapiens
  FIX_S365Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDQGGPHVTEVEGTSFLTGIISWGEECAMKGKYGIYTKVSRYVNWIKEKTKLT

SEQ ID NO: 816 - protein, 415 aa, Homo sapiens
  FIX_S365H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDHGGPHVTEVEGTSFLTGIISWGEECAMKGKYGIYTKVSRYVNWIKEKTKLT

SEQ ID NO: 817 - protein, 415 aa, Homo sapiens
  FIX_G366N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSNGPHVTEVEGTSFLTGIISWGEECAMKGKYGIYTKVSRYVNWIKEKTKLT

SEQ ID NO: 818 - protein, 415 aa, Homo sapiens
  FIX_G366Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSQGPHVTEVEGTSFLTGIISWGEECAMKGKYGIYTKVSRYVNWIKEKTKLT

SEQ ID NO: 819 - protein, 415 aa, Homo sapiens
  FIX_G366H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSHGPHVTEVEGTSFLTGIISWGEECAMKGKYGIYTKVSRYVNWIKEKTKLT

SEQ ID NO: 820 - protein, 415 aa, Homo sapiens
  FIX_G367N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGNPHVTEVEGTSFLTGIISWGEECAMKGKYGIYTKVSRYVNWIKEKTKLT

SEQ ID NO: 821 - protein, 415 aa, Homo sapiens
  FIX_G367Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGQPHVTEVEGTSFLTGIISWGEECAMKGKYGIYTKVSRYVNWIKEKTKLT

SEQ ID NO: 822 - protein, 415 aa, Homo sapiens
  FIX_G367H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGHPHVTEVEGTSFLTGIISWGEECAMKGKYGIYTKVSRYVNWIKEKTKLT

SEQ ID NO: 823 - protein, 415 aa, Homo sapiens
  FIX_V370N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHNTEVEGTSFLTGIISWGEECAMKGKYGIYTKVSRYVNWIKEKTKLT

SEQ ID NO: 824 - protein, 415 aa, Homo sapiens
  FIX_V370Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHQTEVEGTSFLTGIISWGEECAMKGKYGIYTKVSRYVNWIKEKTKLT

SEQ ID NO: 825 - protein, 415 aa, Homo sapiens
  FIX_V370H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHHTEVEGTSFLTGIISWGEECAMKGKYGIYTKVSRYVNWIKEKTKLT

SEQ ID NO: 826 - protein, 415 aa, Homo sapiens
  FIX_T371N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVNEVEGTSFLTGIISWGEECAMKGKYGIYTKVSRYVNWIKEKTKLT

SEQ ID NO: 827 - protein, 415 aa, Homo sapiens
  FIX_T371Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVQEVEGTSFLTGIISWGEECAMKGKYGIYTKVSRYVNWIKEKTKLT

SEQ ID NO: 828 - protein, 415 aa, Homo sapiens
  FIX_T371H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVHEVEGTSFLTGIISWGEECAMKGKYGIYTKVSRYVNWIKEKTKLT

SEQ ID NO: 829 - protein, 415 aa, Homo sapiens
  FIX_V373N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTENEGTSFLTGIISWGEECAMKGKYGIYTKVSRYVNWIKEKTKLT

SEQ ID NO: 830 - protein, 415 aa, Homo sapiens
  FIX_V373Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEQEGTSFLTGIISWGEECAMKGKYGIYTKVSRYVNWIKEKTKLT

SEQ ID NO: 831 - protein, 415 aa, Homo sapiens
  FIX_V373H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEHEGTSFLTGIISWGEECAMKGKYGIYTKVSRYVNWIKEKTKLT

SEQ ID NO: 832 - protein, 415 aa, Homo sapiens
  FIX_G375N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVENTSFLTGIISWGEECAMKGKYGIYTKVSRYVNWIKEKTKLT

SEQ ID NO: 833 - protein, 415 aa, Homo sapiens
  FIX_G375Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEQTSFLTGIISWGEECAMKGKYGIYTKVSRYVNWIKEKTKLT

SEQ ID NO: 834 - protein, 415 aa, Homo sapiens
  FIX_G375H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEHTSFLTGIISWGEECAMKGKYGIYTKVSRYVNWIKEKTKLT

SEQ ID NO: 835 - protein, 415 aa, Homo sapiens
  FIX_T376N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGNSFLTGIISWGEECAMKGKYGIYTKVSRYVNWIKEKTKLT

SEQ ID NO: 836 - protein, 415 aa, Homo sapiens
  FIX_T376Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGQSFLTGIISWGEECAMKGKYGIYTKVSRYVNWIKEKTKLT

SEQ ID NO: 837 - protein, 415 aa, Homo sapiens
  FIX_T376H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGHSFLTGIISWGEECAMKGKYGIYTKVSRYVNWIKEKTKLT

SEQ ID NO: 838 - protein, 415 aa, Homo sapiens
  FIX_S377N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTNFLTGIISWGEECAMKGKYGIYTKVSRYVNWIKEKTKLT

SEQ ID NO: 839 - protein, 415 aa, Homo sapiens
  FIX_S377Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTQFLTGIISWGEECAMKGKYGIYTKVSRYVNWIKEKTKLT

SEQ ID NO: 840 - protein, 415 aa, Homo sapiens
  FIX_S377H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTHFLTGIISWGEECAMKGKYGIYTKVSRYVNWIKEKTKLT

SEQ ID NO: 841 - protein, 415 aa, Homo sapiens
  FIX_T380N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLNGIISWGEECAMKGKYGIYTKVSRYVNWIKEKTKLT

SEQ ID NO: 842 - protein, 415 aa, Homo sapiens
  FIX_T380Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLQGIISWGEECAMKGKYGIYTKVSRYVNWIKEKTKLT

SEQ ID NO: 843 - protein, 415 aa, Homo sapiens
  FIX_T380H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLHGIISWGEECAMKGKYGIYTKVSRYVNWIKEKTKLT

SEQ ID NO: 844 - protein, 415 aa, Homo sapiens
  FIX_G381N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTNIISWGEECAMKGKYGIYTKVSRYVNWIKEKTKLT

SEQ ID NO: 845 - protein, 415 aa, Homo sapiens
  FIX_G381Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTQIISWGEECAMKGKYGIYTKVSRYVNWIKEKTKLT

SEQ ID NO: 846 - protein, 415 aa, Homo sapiens
  FIX_G381H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTHIISWGEECAMKGKYGIYTKVSRYVNWIKEKTKLT

SEQ ID NO: 847 - protein, 415 aa, Homo sapiens
  FIX_I382N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGNISWGEECAMKGKYGIYTKVSRYVNWIKEKTKLT

SEQ ID NO: 848 - protein, 415 aa, Homo sapiens
  FIX_I382Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGQISWGEECAMKGKYGIYTKVSRYVNWIKEKTKLT

SEQ ID NO: 849 - protein, 415 aa, Homo sapiens
  FIX_I382H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGHISWGEECAMKGKYGIYTKVSRYVNWIKEKTKLT

SEQ ID NO: 850 - protein, 415 aa, Homo sapiens
  FIX_I383N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGINSWGEECAMKGKYGIYTKVSRYVNWIKEKTKLT

SEQ ID NO: 851 - protein, 415 aa, Homo sapiens
  FIX_I383Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIQSWGEECAMKGKYGIYTKVSRYVNWIKEKTKLT

SEQ ID NO: 852 - protein, 415 aa, Homo sapiens
  FIX_I383H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIHSWGEECAMKGKYGIYTKVSRYVNWIKEKTKLT

SEQ ID NO: 853 - protein, 415 aa, Homo sapiens
  FIX_S384N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIINWGEECAMKGKYGIYTKVSRYVNWIKEKTKLT

SEQ ID NO: 854 - protein, 415 aa, Homo sapiens
  FIX_S384Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIIQWGEECAMKGKYGIYTKVSRYVNWIKEKTKLT

SEQ ID NO: 855 - protein, 415 aa, Homo sapiens
  FIX_S384H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIIHWGEECAMKGKYGIYTKVSRYVNWIKEKTKLT

SEQ ID NO: 856 - protein, 415 aa, Homo sapiens
  FIX_G386N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWNEECAMKGKYGIYTKVSRYVNWIKEKTKLT

SEQ ID NO: 857 - protein, 415 aa, Homo sapiens
  FIX_G386Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWQEECAMKGKYGIYTKVSRYVNWIKEKTKLT

SEQ ID NO: 858 - protein, 415 aa, Homo sapiens
  FIX_G386H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWHEECAMKGKYGIYTKVSRYVNWIKEKTKLT

SEQ ID NO: 859 - protein, 415 aa, Homo sapiens
  FIX_A390N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECNMKGKYGIYTKVSRYVNWIKEKTKLT

SEQ ID NO: 860 - protein, 415 aa, Homo sapiens
  FIX_A390Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECQMKGKYGIYTKVSRYVNWIKEKTKLT

SEQ ID NO: 861 - protein, 415 aa, Homo sapiens
  FIX_A390H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECHMKGKYGIYTKVSRYVNWIKEKTKLT

SEQ ID NO: 862 - protein, 415 aa, Homo sapiens
  FIX_G393N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKNKYGIYTKVSRYVNWIKEKTKLT

SEQ ID NO: 863 - protein, 415 aa, Homo sapiens
  FIX_G393Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKQKYGIYTKVSRYVNWIKEKTKLT

SEQ ID NO: 864 - protein, 415 aa, Homo sapiens
  FIX_G393H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKHKYGIYTKVSRYVNWIKEKTKLT

SEQ ID NO: 865 - protein, 415 aa, Homo sapiens
  FIX_G396N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYNIYTKVSRYVNWIKEKTKLT

SEQ ID NO: 866 - protein, 415 aa, Homo sapiens
  FIX_G396Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYQIYTKVSRYVNWIKEKTKLT

SEQ ID NO: 867 - protein, 415 aa, Homo sapiens
  FIX_G396H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYHIYTKVSRYVNWIKEKTKLT

SEQ ID NO: 868 - protein, 415 aa, Homo sapiens
  FIX_I397N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGNYTKVSRYVNWIKEKTKLT

SEQ ID NO: 869 - protein, 415 aa, Homo sapiens
  FIX_I397Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGQYTKVSRYVNWIKEKTKLT

SEQ ID NO: 870 - protein, 415 aa, Homo sapiens
  FIX_I397H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGHYTKVSRYVNWIKEKTKLT

SEQ ID NO: 871 - protein, 415 aa, Homo sapiens
  FIX_T399N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYNKVSRYVNWIKEKTKLT

SEQ ID NO: 872 - protein, 415 aa, Homo sapiens
  FIX_T399Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYQKVSRYVNWIKEKTKLT

SEQ ID NO: 873 - protein, 415 aa, Homo sapiens
  FIX_T399H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYHKVSRYVNWIKEKTKLT

SEQ ID NO: 874 - protein, 415 aa, Homo sapiens
  FIX_V401N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKNSRYVNWIKEKTKLT

SEQ ID NO: 875 - protein, 415 aa, Homo sapiens
  FIX_V401Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKQSRYVNWIKEKTKLT

SEQ ID NO: 876 - protein, 415 aa, Homo sapiens
  FIX_V401H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKHSRYVNWIKEKTKLT

SEQ ID NO: 877 - protein, 415 aa, Homo sapiens
  FIX_S402N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVNRYVNWIKEKTKLT

SEQ ID NO: 878 - protein, 415 aa, Homo sapiens
  FIX_S402Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVQRYVNWIKEKTKLT

SEQ ID NO: 879 - protein, 415 aa, Homo sapiens
  FIX_S402H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVHRYVNWIKEKTKLT

SEQ ID NO: 880 - protein, 415 aa, Homo sapiens
  FIX_V405N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYNNWIKEKTKLT

SEQ ID NO: 881 - protein, 415 aa, Homo sapiens
  FIX_V405Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYQNWIKEKTKLT

SEQ ID NO: 882 - protein, 415 aa, Homo sapiens
  FIX_V405H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYHNWIKEKTKLT

SEQ ID NO: 883 - protein, 415 aa, Homo sapiens
  FIX_I408N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWNKEKTKLT

SEQ ID NO: 884 - protein, 415 aa, Homo sapiens
  FIX_I408Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWQKEKTKLT

SEQ ID NO: 885 - protein, 415 aa, Homo sapiens
  FIX_I408H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWHKEKTKLT

SEQ ID NO: 886 - protein, 415 aa, Homo sapiens
  FIX_T412N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKNKLT

SEQ ID NO: 887 - protein, 415 aa, Homo sapiens
  FIX_T412Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKQKLT

SEQ ID NO: 888 - protein, 415 aa, Homo sapiens
  FIX_T412H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKHKLT

SEQ ID NO: 889 - protein, 415 aa, Homo sapiens
  FIX_T415N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLN

SEQ ID NO: 890 - protein, 415 aa, Homo sapiens
  FIX_T415Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLQ

SEQ ID NO: 891 - protein, 415 aa, Homo sapiens
  FIX_T415H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLH

SEQ ID NO: 892 - protein, 415 aa, Homo sapiens
  FIX_T148A mature
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 893 - protein, 461 aa, Homo sapiens [sequence omitted]

SEQ ID NO: 894 - protein, 145 aa, Homo sapiens
  FIX light chain
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTR

SEQ ID NO: 895 - protein, 35 aa, Homo sapiens
  FIX_Activation peptide
AETVFPDVDYVNSTEAETILDNITQSTQSFNDFTR

SEQ ID NO: 896 - protein, 235 aa, Homo sapiens
VVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 897 - DNA, 1437 bp, Homo sapiens
  FIX nucleotide
  CDS (1)...(1389)
atgcagcgcgtgaacatgatcatggcagaatcaccaagcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaaccacgagaagtttttgaaaacactgaaaagacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgaggctgtttttcctgatgtggactatgtaaatcctactgaagctgaaaccattttggataacatcactcaaggcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgagcaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctgggcaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacag

SEQ ID NO: 898 - protein, 416 aa, Bos taurus
  FIX bovine
YNSGKLEEFVRGNLERECKEEKCSFEEAREVFENTEKTTEFWKQYVDGDQCESNPCLNGGMCKDDINSYECWCQAGFEGTNCELDATCSIKNGRCKQFCKRDTDNKVVCSCTDGYRLAEDQKSCEPAVPFPCGRVSVSHISKKLTRAETIFSNTNYENSSEAEIIWDNVTQSNQSFDEFSRVVGGEDAERGQFPWQVLLHGEIAAFCGGSIVNEKWVVTAAHCIKPGVKITVVAGEHNTEKPEPTEQKRNVIRAIPYHSYNASINKYSHDIALLELDEPLELNSYVTPICIADRDYTNIFSKFGYGYVSGWGKVFNRGRSASILQYLKVPLVDRATCLRSTKFSIYSHMFCAGYHEGGKDSCQGDSGGPHVTEVEGTSFLTGIISWGEECAMKGKYGIYTKVSRYVNWIKEKTKLT

SEQ ID NO: 899 - protein, 452 aa, Canis familiaris
  FIX_canine
MAEASGLVTVCLLGYLLSAECAVFLDRENATKILSRPKRYNSGKLEEFVRGNLERECIEEKCSFEEAREVFENTEKTTEFWKQYVDGDQCESNPCLNDGVCKDDINSYECWCRAGFEGKNCELDVTCNIKNGRCKQFCKLGPDNKVVCSCTTGYQLAEDQRSCEPAVPFPCGRVSVPHISMTRTRAETLFSNMDYENSTEVEKILDNVTQPLNDFTRVVGGKDAKPGQFPWQVLLNGKVDAFCGGSIINEKWVVTAAHCIEPDVKITIVAGEHNTEKREHTEQKRNVIRTILHHSYNATINKYNHDIALLELDEPLTLNSYVTPICIADREYSNIFLKFGSGYVSGWGRVFNKGRSASILQYLKVPLVDRATCLRSTKFTIYNNMFCAGFHEGGKDSCQGDSGGPHVTEVEGISFLTGIISWGEECAMKGKYGIYTKVSRYVNWIKEKTKLT

SEQ ID NO: 900 - protein, 285 aa, Cavia porcellus
  FIX guinea pig
RVSIPSVSKEHNRANAIFSRMGYVNFTDDETIWDDNDDDETIWDNSTESTKPSDEFFRVVGGEDAKPGQFPWQVLLNGETEAFCGGSIVNEKWIVTAAHCILPGIKIEVVAGKHNIEKKEDTEQRRNVTQIILHHSYNASFNKYSHDIALLELDKPLSLNSYVTPICIANREYTNIFLKFGAGYVSGWGKLFSQGRTASILQYLRVPLVDRATCLRSTKFTIYNNMFCAGFHEGGRDSCQGDSGGPHVTEVEGTNFLTGIISWGEECAMKGKYGIYTKVSRYVNW

SEQ ID NO: 901 - protein, 471 aa, Gallus gallus
  FIX chicken
MAKIPLILSFCLLEAFLGAESTVFIENKEASTVLSRTRRGNSNRLEELIPGNLERECIEEKCSFEEAREVFENTEKTMEFWKIYIDGDQCNSNPCKNGAVCKDGVSSYECMCPPGYGGRNCEIDSTCATKNGGCEHFCRHDTPQKAVCSCASGYKLHEDGKSCKPAVPYPCGRITAPEMRGKVTRTENTIERWNITAHDEGDAHDEALDITEPPPPPTTSAAPAKIVPITKNDTRVVGGYDSVKGQLPWQVHLVDSRGLGFCGGSIINEKWVVTAAHCLEPGDNVTAVAGEYNTKEDDHTEQRRQVVKILPYPTYNRTRNKHHNDIALLELDQPLTFNSYVTPICIGSRDFTNNLLSNGPGTVSGWGSMLYRGRSAIVLQVLTVPFVDRVTCLKSTSTTILHSMFCAGYTAGGKDTCGGDSGGPYTNSIGETWFLTGVTSWGEECAKPGKYGIYTKVAKYVKWIRETTRLT

SEQ ID NO: 902 - protein, 466 aa, Felis silvestris
  FIX feline
MRCLNMIMAEPPGLITICLLGYLLGADCTVFLDHEDATKVLSRPKRYNSGKLEEFVQGNLERECMEEKCSFEEAREVFENTEKTTEFWKQYVDGDQCESNPCLNGGICKDDINSYECWCQTGFEGKNCELDVTCNIKNGRCKQFCKLDADNKVVCSCTTGYQLAEDQKSCEPAVPFPCGRVSVPHISTTHTRAETLFLNMDYENSTTDYENSAEAEKNVDNVTQPLNDLTRIVGGKTAKPGQFPWQVLLKGKIDAFCGGSIINEKWVVTAAHCINPDVEITVVAGEHNTEETEHTEQKRNVIRTILHHSYNASVNKYSHDIALLELDEPLTLNSYVTPICVADREYTNTFLKFGYGYVSGWGKVFNKGRPATILQYLKVPLVDRATCLRSTKFTIYNNMFCAGFHEGGKDSCQGDSGGPHVTEVEGINFLTGIISWGEECAMKGKYGIYTKVSRYVNWIKEKTKLT

SEQ ID NO: 903 - protein, 471 aa, Mus musculus
  FIX murine
MKHLNTVMAESPALITIFLLGYLLSTECAVFLDRENATKILTRPKRYNSGKLEEFVRGNLERECIEERCSFEEAREVFENTEKTTEFWKQYVDGDQCESNPCLNGGICKDDISSYECWCQVGFEGRNCELDATCNIKNGRCKQFCKNSPDNKVICSCTEGYQLAEDQKSCEPTVPFPCGRASISYSSKKITRAETVFSNMDYENSTEAVFIQDDITDGAILNNVTESSESLNDFTRVVGGENAKPGQIPWQVILNGEIEAFCGGAIINEKWIVTAAHCLKPGDKIEVVAGEYNIDKKEDTEQRRNVIRTIPHHQYNATINKYSHDIALLELDKPLILNSYVTPICVANREYTNIFLKFGSGYVSGWGKVFNKGRQASILQYLRVPLVDRATCLRSTTFTIYNNMFCAGYREGGKDSCEGDSGGPHVTEVEGTSFLTGIISWGEECAMKGKYGIYTKVSRYVNWIKEKTKLT

SEQ ID NO: 904 - protein, 461 aa, Pan troglodytes
  FIX chimpanzee
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVDTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 905 - protein, 409 aa, Sus scrofa
  FIX pig
YNSGKLEESFVRGNLERECIEEKCSFEEAREVFENTEKTNEFWKQYVDGDQCEPNPCLNGGLCKDDINSYECWCQVGFEGKNCELDATCNIKNGRCKQFCKTGADSKVLCSCTTGYRLAPDQKSCKPAVPFPCGRVSVSHSPTTLTRAEIIFSNMDYENSTEVEPILDSLTESNQSSDDFIRIVGGENAKPGQFPWQVLLNGKIDAFCGGSIINEKWVVTAAHCIEPGVKITVVAGEYNTEETEPTEQRRNVIRAIPHHSYNATVNKYSHDIALLELDEPLTLNSYVTPICIADKEYTNIFLKFGSGYVSGWGRVFNRGRSATILQYLKVPLVDRATCLRSTKVTIYSNMFCAGFHEGGKDSCLGDSGGPHVTEVEGTSFLTGIISWGEECAVKGKYGIYTKVSRYVNW

SEQ ID NO: 906 - protein, 275 aa, Oryctolagus cuniculus
  FIX rabbit
GVSVSHASKKITRATTIFSNTEYENFTEAETIRGNVTQRSQSSDDFTRIVGGENAKPGQFPWQVLLNGKVEAFCGGSIINEKWVVTAAHCIKPDDNITVVAGEYNIQETENTEQKRNVIRIIPYHKYNATINKYNHDIALLELDKPLTLNSYVTPICIANREYTNIFLNFGSGYVSGWGRVFNRGRQASILQYLRVPFVDRATCLRSTKFTIYNNMFCAGFDVGGKDSCEGDSGGPHVTEVEGTSFLTGIISWGEECAIKGKYGVYTRVSWYVNW

SEQ ID NO: 907 - protein, 282 aa, Rattus norvegicus
  FIX rat
RVSVAYNSKKITRAETVFSNTDYGNSTELILDDITNSTILDNLTENSEPINDFTRVVGGENAKPGQIPWQVILNGEIEAFCGGAIINEKWIVTAAHCLKPGDKIEVVAGEHNIDEKEDTEQRRNVIRTIPHHQYNATINKYSHDIALLELDKPLILNSYVTPICVANKEYTNIFLKFGSGYVSGWGKVFNKGRQASILQYLRVPLVDRATCLRSTKFSIYNNMFCAGYREGGKDSCEGDSGGPHVTEVEGTSFLTGIISWGEECAMKGKYGIYTKVSRYVNW

SEQ ID NO: 908 - protein, 274 aa, Ovis aries
  FIX ovine
RASVLHTSKKLTRAETIFSNMNYENSSEAEIIWDNVTQSNQSFDDFNRVVGGEDAARGQFPWQVLLHGEIAAFCGGSIVNEKWVVTAAHCIKPGVKITVVAGEHNTEKPEPTEQKRNVIRAIPYHGYNASINKYSHDIALLELDEPLELNSYVTPICIADREYTNIFLKFGYGYVSGWGRVFNRGRSASILQYLKVPLVDRATCLRSTKFTIYNHMFCAGYHEGGKDSCQGDSGGPHVTEVEGTSFLTGIISWGEECAMKGKYGIYTKVSRYEV

SEQ ID NO: 909 - protein, 463 aa, Xenopus tropicalis
  FIX frog
MVAFSSILIIYLLTSLCSTEKAVFLSDESASSLLVRQKRYNTGRLEEWVAGNLERECLEEKCNYEEAREVFENDDKTKEFWKQYIDGDQCLSNPCLNGGVCKDDVSDYVCWCQQGYSGKNCELELPVICSIMNGGCDHMCRDDPVKKVICSCASGYKLAENGKTCEAAVPYPCGRVSSPEALPKEETRSFLDSLEQNLTSAAHPNITDQEKPKEDIVPVTVDPNVRIVGGTDSLKGEFPWQVHLVNKDNLGFCSGSIINEKWIVTAAHCFLIRGEFKVVAGEHNTEVSDGTEQHHKVTRIILYPAYNATRSKYNNDIALLELEKPLELNDYVRPVCIGNMDFTEKLLKRNAFSMVSGWGDLGYKGRPAVILQKLAVPYINQAACKKSSRFSIYANMFCAGYSDESKDTCQGDSGGPHVTEYKNLWFLTGITSWGEKCAEKDKYGVYTRLSRFTDWIRTTTKIS

SEQ ID NO: 910 - protein, 503 aa, Brachydanio rerio
  FIX zebrafish
MASFILVLFPFLLLQAALGSVFLDGEKADSVLWRRRRANTWLFEEFLPGNVERECIEEKCVLEEAREAFENDEKTMEFWASYVDGNQCKPSPCQNQGTCEDQMGTYSCNCLARFCWQNCEIVTAKKCDVDNGGCEHFCVLLESHKTQCRVHMDTNSQKMDFTCEPIVKFPCGKTSKPAVKTFGTASVTNTTAQSSNKTIKSTSSIPKPDNLTNPTNSKDIKEKLAPPRAKLPKWAFEEYLTSPAPTVSGLKSRIIGGNSALPGEIPWQVALVSRSTQQVFCGGSILNPLWVITAAHCLLGNHNGSFYIRVGEHDVSKIEGTEQNVDVIKLISHPRYNSKVSLFNHDIALLRLRSPIRLTPTVRPICLGPMVFSNTLLQSGTLATVSGWGRVRFQGRSAATLQKIELPYVDRTVCKESSSDPITHFMFCAGHSDSPKDACQGDSGGPHVMRYHNTWFLTGIISWGEECAKKGKYGVYTQVGNYYRWIQHTMGVTTGALLTNVDQ

SEQ ID NO: 911 - protein, 537 aa, Fugu rubripes
  FIX pufferfish
MARDFLLALIAALLLEVSGLPTEGSTGGVFVSPQAANMVLLRQRRYNSGHLEELQKDNLERECKEEQCTMEEAREVFEDDEKTAEFWVGYIDGDQCVPPPCQNEGVCKDGINSYVCWCKPDFSGRNCEIEVSKQCSVNNGGCSHFCVMQGDISVCHCAVGHRLGLDKKSCEPTDQFSCGHINMSFSSKSNVQRRSLMQKLEANRTFSSILLGDYSDNSTELYDYIESMDWAPPNTTMIDPRSGRTSSVGPDQNRSSLTEDLISVSETEIPYWAFPTLPTIPEKENTDQRIVGGDEALPGEIPWQVTLMSHSVILQRAEPFCGGSLFSDLWVITAAHCLINEKIAKQGILHSSREHDVSKDEGPERDHTVAEQHIHFMYDYKKSPYNHDIALLKLNKPVELSNKRRPICLGPKDFTETLLRESTSSLVSGWGRIKFFGLEATKLQKLEVPYVDRTRCKQSSREQVTRYMFCAGYQLQAKDSCQGDSGGPHATKYKDTWFLTGIVSWGEECAKDGKYGIYTRVSRYYPWISQKTGLQMS

SEQ ID NO: 912 - protein, 463 aa, Macaca mulatta
  FIX Rhesus Macacque
MQRVNMIIMAESPGLITICLLGYLLSAECTVFLDHENANKILNRPKRYNSGKLEEFVQGNLERECMEEKCNFEEAREVFENTEKTTEFWKQYVDGDQCESNPCLNGGSCKDDINSYECWCPFGFEGKNCELDVTCNIKNGRCKQFCKNTADNKVVCSCTEGYRLAENQKSCEPAVPFPCGRVSVSQTSTLTRAETVFPDVEYVNSTEAETILDNITQSTQSFNDFTRVVGGEDAKPGQFPWQVVLNGKVDAFCGGSIVNEKWVVTAAHCVETDAKITVVAGEHNIEETEHTEQKRNVIRRIIPHHNYNATINKYNHDIALLELDEPLVLNSYVTPICIADKEYTNIFLKFGSGYVSGWGRVFNKGRSASVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 913 - DNA, 36 bp, Artificial Sequence
  Primer FIX_HIND
gcattaggataagcttggatgcagcgcgtgaacatg

SEQ ID NO: 914 - DNA, 34 bp, Artificial Sequence
  Primer FIX_XBA
gcatcggcgcagatctctgttaattttcaattcc

SEQ ID NO: 915 - DNA, 3519 bp, Artificial Sequence
  Plasmid pCR-Blunt II-TOPO
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 916 - DNA, 4725 bp, Artificial Sequence
  Plasmid pNaut-FIX_M2-EcoRI
gcgcccaatacgcaaaccgcctctccccgcgcgttggccgattcattaatgcagctgctaggggttccttgtagttaatgattaacccgccatgctacttatctactatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaaagcttttttggatttcttacagtgatggtgatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagtctagaaagggcgaattccagcacactggcggccgttactagtggatccactagtaacggccgccagtgtgctggaattctgcagatatccatcacactggcggccgctcgagcatgcatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccaggtagataagtagcatggcgggttaatcattaactacacagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 917 - protein, 415 aa, Homo sapiens
  T163H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 918 - protein, 415 aa, Homo sapiens
  I164Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 919 - protein, 415 aa, Homo sapiens
  T169H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 920 - protein, 415 aa, Homo sapiens
  S171Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 921 - protein, 415 aa, Homo sapiens
  D152N/D154N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPNVNYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 922 - protein, 415 aa, Homo sapiens
  S174Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 923 - protein, 415 aa, Homo sapiens
  S174H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 924 - protein, 415 aa, Homo sapiens
  T179Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 925 - protein, 415 aa, Homo sapiens
  T179H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 926 - protein, 415 aa, Homo sapiens
  T163N/I174N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 927 - protein, 415 aa, Homo sapiens
  D166Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 928 - protein, 415 aa, Homo sapiens
  D166N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 929 - protein, 415 aa, Homo sapiens
  D186Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 930 - protein, 415 aa, Homo sapiens
  D186N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 931 - protein, 415 aa, Homo sapiens
  T148A/D152N/D154N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 932 - protein, 415 aa, Homo sapiens
  F192I/D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 933 - protein, 415 aa, Homo sapiens
  F192I/D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 934 - protein, 415 aa, Homo sapiens
  D152N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPNVDYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 935 - protein, 415 aa, Homo sapiens
  D152Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPQVDYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 936 - protein, 415 aa, Homo sapiens
  T148A/D154N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 937 - protein, 415 aa, Homo sapiens
  D154N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVNYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 938 - protein, 415 aa, Homo sapiens
  D154Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVQYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 939 - protein, 415 aa, Homo sapiens
  T163N/I164N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 940 - protein, 415 aa, Homo sapiens
  A187N/G190N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDNKPNQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 941 - protein, 415 aa, Homo sapiens
  V196N/V197N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQNNLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 942 - protein, 415 aa, Homo sapiens
  T140N/T144N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQNSKLNRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 943 - protein, 415 aa, Homo sapiens
  F175I/F178I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSINDITRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 944 - protein, 415 aa, Homo sapiens
  F192I/W194I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQIPIQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 945 - protein, 415 aa, Homo sapiens
  T148A/D152N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 946 - protein, 415 aa, Homo sapiens
  T148A/D152Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPQVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 947 - protein, 415 aa, Homo sapiens
  T148A/D154N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 948 - protein, 415 aa, Homo sapiens
  T148A/D154Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVQYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 949 - protein, 415 aa, Homo sapiens
  D152N/D154N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPNVNYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 950 - protein, 415 aa, Homo sapiens
  I168N/T169N/S171N/T172N/S174N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNNNQNNQNFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 951 - protein, 415 aa, Homo sapiens
  T179N/V181N/V182N/G183N/G184N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFNRNNNNEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 952 - protein, 415 aa, Homo sapiens
  D152N/D154N/T148A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 953 - protein, 415 aa, Homo sapiens
  T163H/D166Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILQNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 954 - protein, 415 aa, Homo sapiens
  T163H/D166N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILNNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 955 - protein, 415 aa, Homo sapiens
  T163H/D186Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 956 - protein, 415 aa, Homo sapiens
  T163H/D186N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 957 - protein, 415 aa, Homo sapiens
  T163H/F192I/D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 958 - protein, 415 aa, Homo sapiens
  T163H/F192I/D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 959 - protein, 415 aa, Homo sapiens
  T148A/D152N/D154N/T163H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAEHILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 960 - protein, 415 aa, Homo sapiens
  T148A/D154N/T163H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAEHILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 961 - protein, 415 aa, Homo sapiens
  I164Q/D166Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLQNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 962 - protein, 415 aa, Homo sapiens
  I164Q/D166N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLNNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 963 - protein, 415 aa, Homo sapiens
  I164Q/D186Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 964 - protein, 415 aa, Homo sapiens
  I164Q/D186N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 965 - protein, 415 aa, Homo sapiens
  I164Q/F192I/D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 966 - protein, 415 aa, Homo sapiens
  I164Q/F192I/D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 967 - protein, 415 aa, Homo sapiens
  T148A/D152N/D154N/I164Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETQLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 968 - protein, 415 aa, Homo sapiens
  T148A/D154N/I164Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETQLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 969 - protein, 415 aa, Homo sapiens
  T163N/I164N/D166Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLQNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 970 - protein, 415 aa, Homo sapiens
  T163N/I164N/D166N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLNNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 971 - protein, 415 aa, Homo sapiens
  T163N/I164N/D186Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 972 - protein, 415 aa, Homo sapiens
  T163N/I164N/D186N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 973 - protein, 415 aa, Homo sapiens
  T163N/I164N/F192I/D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 974 - protein, 415 aa, Homo sapiens
  T163N/I164N/F192I/D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 975 - protein, 415 aa, Homo sapiens
  T148A/D152N/D154N/T163N/I164N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAENNLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 976 - protein, 415 aa, Homo sapiens
  T148A/D154N/T163N/I164N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAENNLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 977 - protein, 415 aa, Homo sapiens
  D166Q/T169H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNIHQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 978 - protein, 415 aa, Homo sapiens
  D166N/T169H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNIHQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 979 - protein, 415 aa, Homo sapiens
  T169H/D186Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 980 - protein, 415 aa, Homo sapiens
  T169H/D186N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 981 - protein, 415 aa, Homo sapiens
  T169H/F192I/D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 982 - protein, 415 aa, Homo sapiens
  T169H/F192I/D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 983 - protein, 415 aa, Homo sapiens
  T148A/D152N/D154N/T169H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNIHQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 984 - protein, 415 aa, Homo sapiens
  T148A/D154N/T169H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNIHQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 985 - protein, 415 aa, Homo sapiens
  D166Q/S171Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQQTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 986 - protein, 415 aa, Homo sapiens
  D166N/S171Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQQTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 987 - protein, 415 aa, Homo sapiens
  S171Q/D186Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 988 - protein, 415 aa, Homo sapiens
  S171Q/D186N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 989 - protein, 415 aa, Homo sapiens
  S171Q/F192I/D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 990 - protein, 415 aa, Homo sapiens
  S171Q/F192I/D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 991 - protein, 415 aa, Homo sapiens
  T148A/D152N/D154N/S171Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQQTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 992 - protein, 415 aa, Homo sapiens
  T148A/D154N/S171Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQQTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 993 - protein, 415 aa, Homo sapiens
  D166Q/S174Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQQFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 994 - protein, 415 aa, Homo sapiens
  D166N/S174Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQQFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 995 - protein, 415 aa, Homo sapiens
  S174Q/D186Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 996 - protein, 415 aa, Homo sapiens
  S174Q/D186N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 997 - protein, 415 aa, Homo sapiens
  S174Q/F192I/D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 998 - protein, 415 aa, Homo sapiens
  S174Q/F192I/D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 999 - protein, 415 aa, Homo sapiens
  T148A/D152N/D154N/S174Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQQFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1000 - protein, 415 aa, Homo sapiens
  T148A/D154N/S174Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQQFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1001 - protein, 415 aa, Homo sapiens
  D166Q/S174H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQHFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1002 - protein, 415 aa, Homo sapiens
  D166N/S174H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQHFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1003 - protein, 415 aa, Homo sapiens
  S174H/D186Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1004 - protein, 415 aa, Homo sapiens
  S174H/D186N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1005 - protein, 415 aa, Homo sapiens
  S174H/F192I/D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1006 - protein, 415 aa, Homo sapiens
  S174H/F192I/D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1007 - protein, 415 aa, Homo sapiens
  T148A/D152N/D154N/S174H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQHFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1008 - protein, 415 aa, Homo sapiens
  T148A/D154N/S174H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQHFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1009 - protein, 415 aa, Homo sapiens
  D166Q/T179Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQSFNDFQRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1010 - protein, 415 aa, Homo sapiens
  D166N/T179Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQSFNDFQRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1011 - protein, 415 aa, Homo sapiens
  T179Q/D186Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1012 - protein, 415 aa, Homo sapiens
  T179Q/D186N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1013 - protein, 415 aa, Homo sapiens
  T179Q/F192I/D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1014 - protein, 415 aa, Homo sapiens
  T179Q/F192I/D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1015 - protein, 415 aa, Homo sapiens
  T148A/D152N/D154N/T179Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQSFNDFQRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1016 - protein, 415 aa, Homo sapiens
  T148A/D154N/T179Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQSFNDFQRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1017 - protein, 415 aa, Homo sapiens
  D166Q/T179H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQSFNDFHRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1018 - protein, 415 aa, Homo sapiens
  D166N/T179H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQSFNDFHRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1019 - protein, 415 aa, Homo sapiens
  T179H/D186Q/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1020 - protein, 415 aa, Homo sapiens
  T179H/D186N/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1021 - protein, 415 aa, Homo sapiens
  T179H/F192I/D203Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1022 - protein, 415 aa, Homo sapiens
  T179H/F192I/D203N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1023 - protein, 415 aa, Homo sapiens
  T148A/D152N/D154N/T179H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQSFNDFHRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1024 - protein, 415 aa, Homo sapiens
  T148A/D154N/T179H/F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQSFNDFHRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1025 - protein, 415 aa, Homo sapiens
  L165Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETIQDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1026 - protein, 415 aa, Homo sapiens
  L165H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETIHDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1027 - protein, 415 aa, Homo sapiens
  F175H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSHNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1028 - protein, 415 aa, Homo sapiens
  F178H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDHTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1029 - protein, 415 aa, Homo sapiens
  F192H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQHPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1030 - protein, 415 aa, Homo sapiens
  F192I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1031 - protein, 415 aa, Homo sapiens
  F192V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQVPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1032 - protein, 415 aa, Homo sapiens
  W194I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPIQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1033 - protein, 415 aa, Homo sapiens
  L198Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVQNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1034 - protein, 415 aa, Homo sapiens
  L198H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVHNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1035 - protein, 415 aa, Homo sapiens
  FIX_M2_mature
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1036 - protein, 415 aa, Homo sapiens
  FIX_M2_Y1H
HNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1037 - protein, 415 aa, Homo sapiens
  FIX_M2_Y1I
INSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1038 - protein, 415 aa, Homo sapiens
  FIX_M2_K5N
YNSGNLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1039 - protein, 415 aa, Homo sapiens
  FIX_M2_K5Q
YNSGQLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1040 - protein, 415 aa, Homo sapiens
  FIX_M2_L6I
YNSGKIEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1041 - protein, 415 aa, Homo sapiens
  FIX_M2_L6V
YNSGKVEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1042 - protein, 415 aa, Homo sapiens
  FIX_M2_E7Q
YNSGKLQEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1043 - protein, 415 aa, Homo sapiens
  FIX_M2_E7H
YNSGKLHEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1044 - protein, 415 aa, Homo sapiens
  FIX_M2_E7N
YNSGKLNEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1045 - protein, 415 aa, Homo sapiens
  FIX_M2_E8Q
YNSGKLEQFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1046 - protein, 415 aa, Homo sapiens
  FIX_M2_E8H
YNSGKLEHFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1047 - protein, 415 aa, Homo sapiens
  FIX_M2_E8N
YNSGKLENFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1048 - protein, 415 aa, Homo sapiens
  FIX_M2_F9I
YNSGKLEEIVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1049 - protein, 415 aa, Homo sapiens
  FIX_M2_F9V
YNSGKLEEVVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1050 - protein, 415 aa, Homo sapiens
  FIX_M2_L14I
YNSGKLEEFVQGNIERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1051 - protein, 415 aa, Homo sapiens
  FIX_M2_L14V
YNSGKLEEFVQGNVERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1052 - protein, 415 aa, Homo sapiens
  FIX_M2_E15Q
YNSGKLEEFVQGNLQRECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1053 - protein, 415 aa, Homo sapiens
  FIX_M2_E15H
YNSGKLEEFVQGNLHRECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1054 - protein, 415 aa, Homo sapiens
  FIX_M2_E15N
YNSGKLEEFVQGNLNRECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1055 - protein, 415 aa, Homo sapiens
  FIX_M2_R16H
YNSGKLEEFVQGNLEHECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1056 - protein, 415 aa, Homo sapiens
  FIX_M2_R16Q
YNSGKLEEFVQGNLEQECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1057 - protein, 415 aa, Homo sapiens
  FIX_M2_E17Q
YNSGKLEEFVQGNLERQCMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1058 - protein, 415 aa, Homo sapiens
  FIX_M2_E17H
YNSGKLEEFVQGNLERHCMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1059 - protein, 415 aa, Homo sapiens
  FIX_M2_E17N
YNSGKLEEFVQGNLERNCMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1060 - protein, 415 aa, Homo sapiens
  FIX_M2_M19I
YNSGKLEEFVQGNLERECIEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1061 - protein, 415 aa, Homo sapiens
  FIX_M2_M19V
YNSGKLEEFVQGNLERECVEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1062 - protein, 415 aa, Homo sapiens
  FIX_M2_E20Q
YNSGKLEEFVQGNLERECMQEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1063 - protein, 415 aa, Homo sapiens
  FIX_M2_E20H
YNSGKLEEFVQGNLERECMHEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1064 - protein, 415 aa, Homo sapiens
  FIX_M2_E20N
YNSGKLEEFVQGNLERECMNEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1065 - protein, 415 aa, Homo sapiens
  FIX_M2_E21Q
YNSGKLEEFVQGNLERECMEQKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1066 - protein, 415 aa, Homo sapiens
  FIX_M2_E21H
YNSGKLEEFVQGNLERECMEHKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1067 - protein, 415 aa, Homo sapiens
  FIX_M2_E21N
YNSGKLEEFVQGNLERECMENKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1068 - protein, 415 aa, Homo sapiens
  FIX_M2_K22N
YNSGKLEEFVQGNLERECMEENCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1069 - protein, 415 aa, Homo sapiens
  FIX_M2_K22Q
YNSGKLEEFVQGNLERECMEEQCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1070 - protein, 415 aa, Homo sapiens
  FIX_M2_F25I
YNSGKLEEFVQGNLERECMEEKCSIEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1071 - protein, 415 aa, Homo sapiens
  FIX_M2_F25V
YNSGKLEEFVQGNLERECMEEKCSVEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1072 - protein, 415 aa, Homo sapiens
  FIX_M2_E26Q
YNSGKLEEFVQGNLERECMEEKCSFQEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1073 - protein, 415 aa, Homo sapiens
  FIX_M2_E26H
YNSGKLEEFVQGNLERECMEEKCSFHEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1074 - protein, 415 aa, Homo sapiens
  FIX_M2_E26N
YNSGKLEEFVQGNLERECMEEKCSFNEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1075 - protein, 415 aa, Homo sapiens
  FIX_M2_E27Q
YNSGKLEEFVQGNLERECMEEKCSFEQAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1076 - protein, 415 aa, Homo sapiens
  FIX_M2_E27H
YNSGKLEEFVQGNLERECMEEKCSFEHAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1077 - protein, 415 aa, Homo sapiens
  FIX_M2_E27N
YNSGKLEEFVQGNLERECMEEKCSFENAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1078 - protein, 415 aa, Homo sapiens
  FIX_M2_R29H
YNSGKLEEFVQGNLERECMEEKCSFEEAHEVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1079 - protein, 415 aa, Homo sapiens
  FIX_M2_R29Q
YNSGKLEEFVQGNLERECMEEKCSFEEAQEVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1080 - protein, 415 aa, Homo sapiens
  FIX_M2_E30Q
YNSGKLEEFVQGNLERECMEEKCSFEEARQVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1081 - protein, 415 aa, Homo sapiens
  FIX_M2_E30H
YNSGKLEEFVQGNLERECMEEKCSFEEARHVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1082 - protein, 415 aa, Homo sapiens
  FIX_M2_E30N
YNSGKLEEFVQGNLERECMEEKCSFEEARNVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1083 - protein, 415 aa, Homo sapiens
  FIX_M2_F32I
YNSGKLEEFVQGNLERECMEEKCSFEEAREVIENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1084 - protein, 415 aa, Homo sapiens
  FIX_M2_F32V
YNSGKLEEFVQGNLERECMEEKCSFEEAREVVENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1085 - protein, 415 aa, Homo sapiens
  FIX_M2_E33Q
YNSGKLEEFVQGNLERECMEEKCSFEEAREVFQNTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1086 - protein, 415 aa, Homo sapiens
  FIX_M2_E33H
YNSGKLEEFVQGNLERECMEEKCSFEEAREVFHNTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1087 - protein, 415 aa, Homo sapiens
  FIX_M2_E33N
YNSGKLEEFVQGNLERECMEEKCSFEEAREVFNNTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1088 - protein, 415 aa, Homo sapiens
  FIX_M2_E36Q
YNSGKLEEFVQGNLERECMEEKCSFEEAREVFENTQRTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1089 - protein, 415 aa, Homo sapiens
  FIX_M2_E36H
YNSGKLEEFVQGNLERECMEEKCSFEEAREVFENTHRTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1090 - protein, 415 aa, Homo sapiens
  FIX_M2_E36N
YNSGKLEEFVQGNLERECMEEKCSFEEAREVFENTNRTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1091 - protein, 415 aa, Homo sapiens
  FIX_M2_R37H
YNSGKLEEFVQGNLERECMEEKCSFEEAREVFENTEHTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1092 - protein, 415 aa, Homo sapiens
  FIX_M2_R37Q
YNSGKLEEFVQGNLERECMEEKCSFEEAREVFENTEQTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1093 - protein, 415 aa, Homo sapiens
  FIX_M2_K39N
YNSGKLEEFVQGNLERECMEEKCSFEEAREVFENTERTNLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1094 - protein, 415 aa, Homo sapiens
  FIX_M2_K39Q
YNSGKLEEFVQGNLERECMEEKCSFEEAREVFENTERTQLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1095 - protein, 415 aa, Homo sapiens
  FIX_M2_L40I
YNSGKLEEFVQGNLERECMEEKCSFEEAREVFENTERTKIFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1096 - protein, 415 aa, Homo sapiens
  FIX_M2_L40V
YNSGKLEEFVQGNLERECMEEKCSFEEAREVFENTERTKVFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1097 - protein, 415 aa, Homo sapiens
  FIX_M2_F41I
YNSGKLEEFVQGNLERECMEEKCSFEEAREVFENTERTKLIWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1098 - protein, 415 aa, Homo sapiens
  FIX_M2_F41V
YNSGKLEEFVQGNLERECMEEKCSFEEAREVFENTERTKLVWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1099 - protein, 415 aa, Homo sapiens
  FIX_M2_W42S
YNSGKLEEFVQGNLERECMEEKCSFEEAREVFENTERTKLFSISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1100 - protein, 415 aa, Homo sapiens
  FIX_M2_W42H
YNSGKLEEFVQGNLERECMEEKCSFEEAREVFENTERTKLFHISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1101 - protein, 415 aa, Homo sapiens
  FIX_M2_Y45H
YNSGKLEEFVQGNLERECMEEKCSFEEAREVFENTERTKLFWISHSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1102 - protein, 415 aa, Homo sapiens
  FIX_M2_Y45I
YNSGKLEEFVQGNLERECMEEKCSFEEAREVFENTERTKLFWISISDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1103 - protein, 415 aa, Homo sapiens
  FIX_M2_D47N
YNSGKLEEFVQGNLERECMEEKCSFEEAREVFENTERTKLFWISYSNGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1104 - protein, 415 aa, Homo sapiens
  FIX_M2_D47Q
YNSGKLEEFVQGNLERECMEEKCSFEEAREVFENTERTKLFWISYSQGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1105 - protein, 415 aa, Homo sapiens
  FIX_M2_D49N
YNSGKLEEFVQGNLERECMEEKCSFEEAREVFENTERTKLFWISYSDGNQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1106 - protein, 415 aa, Homo sapiens
  FIX_M2_D49Q
YNSGKLEEFVQGNLERECMEEKCSFEEAREVFENTERTKLFWISYSDGQQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1107 - protein, 415 aa, Homo sapiens
  FIX_M2_E52Q
YNSGKLEEFVQGNLERECMEEKCSFEEAREVFENTERTKLFWISYSDGDQCQSNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1108 - protein, 415 aa, Homo sapiens
  FIX_M2_E52H
YNSGKLEEFVQGNLERECMEEKCSFEEAREVFENTERTKLFWISYSDGDQCHSNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1109 - protein, 415 aa, Homo sapiens
  FIX_M2_E52N
YNSGKLEEFVQGNLERECMEEKCSFEEAREVFENTERTKLFWISYSDGDQCNSNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1110 - protein, 415 aa, Homo sapiens
  FIX_M2_P55A
YNSGKLEEFVQGNLERECMEEKCSFEEAREVFENTERTKLFWISYSDGDQCESNACLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1111 - protein, 415 aa, Homo sapiens
  FIX_M2_P55S
YNSGKLEEFVQGNLERECMEEKCSFEEAREVFENTERTKLFWISYSDGDQCESNSCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1112 - protein, 415 aa, Homo sapiens
  FIX_M2_L57I
YNSGKLEEFVQGNLERECMEEKCSFEEAREVFENTERTKLFWISYSDGDQCESNPCINGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1113 - protein, 415 aa, Homo sapiens
  FIX_M2_L57V
YNSGKLEEFVQGNLERECMEEKCSFEEAREVFENTERTKLFWISYSDGDQCESNPCVNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1114 - protein, 415 aa, Homo sapiens
  FIX_M2_N58Q
YNSGKLEEFVQGNLERECMEEKCSFEEAREVFENTERTKLFWISYSDGDQCESNPCLQGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1115 - protein, 415 aa, Homo sapiens
  FIX_M2_N58S
YNSGKLEEFVQGNLERECMEEKCSFEEAREVFENTERTKLFWISYSDGDQCESNPCLSGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1116 - protein, 415 aa, Homo sapiens
  FIX_M2_K63N
YNSGKLEEFVQGNLERECMEEKCSFEEAREVFENTERTKLFWISYSDGDQCESNPCLNGGSCNDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1117 - protein, 415 aa, Homo sapiens
  FIX_M2_K63Q
YNSGKLEEFVQGNLERECMEEKCSFEEAREVFENTERTKLFWISYSDGDQCESNPCLNGGSCQDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1118 - protein, 415 aa, Homo sapiens
  FIX_M2_D64N
YNSGKLEEFVQGNLERECMEEKCSFEEAREVFENTERTKLFWISYSDGDQCESNPCLNGGSCKNDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1119 - protein, 415 aa, Homo sapiens
  FIX_M2_D64Q
YNSGKLEEFVQGNLERECMEEKCSFEEAREVFENTERTKLFWISYSDGDQCESNPCLNGGSCKQDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1120 - protein, 415 aa, Homo sapiens
  FIX_M2_D65N
YNSGKLEEFVQGNLERECMEEKCSFEEAREVFENTERTKLFWISYSDGDQCESNPCLNGGSCKDNINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1121 - protein, 415 aa, Homo sapiens
  FIX_M2_D65Q
YNSGKLEEFVQGNLERECMEEKCSFEEAREVFENTERTKLFWISYSDGDQCESNPCLNGGSCKDQINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1122 - protein, 415 aa, Homo sapiens
  FIX_M2_Y69H
YNSGKLEEFVQGNLERECMEEKCSFEEAREVFENTERTKLFWISYSDGDQCESNPCLNGGSCKDDINSHECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1123 - protein, 415 aa, Homo sapiens
  FIX_M2_Y69I
YNSGKLEEFVQGNLERECMEEKCSFEEAREVFENTERTKLFWISYSDGDQCESNPCLNGGSCKDDINSIECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1124 - protein, 415 aa, Homo sapiens
  FIX_M2_E70Q
YNSGKLEEFVQGNLERECMEEKCSFEEAREVFENTERTKLFWISYSDGDQCESNPCLNGGSCKDDINSYQCWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1125 - protein, 415 aa, Homo sapiens
  FIX_M2_E70H
YNSGKLEEFVQGNLERECMEEKCSFEEAREVFENTERTKLFWISYSDGDQCESNPCLNGGSCKDDINSYHCWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1126 - protein, 415 aa, Homo sapiens
  FIX_M2_E70N
YNSGKLEEFVQGNLERECMEEKCSFEEAREVFENTERTKLFWISYSDGDQCESNPCLNGGSCKDDINSYNCWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1127 - protein, 415 aa, Homo sapiens
  FIX_M2_W72S
YNSGKLEEFVQGNLERECMEEKCSFEEAREVFENTERTKLFWISYSDGDQCESNPCLNGGSCKDDINSYECSCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1128 - protein, 415 aa, Homo sapiens
  FIX_M2_W72H
YNSGKLEEFVQGNLERECMEEKCSFEEAREVFENTERTKLFWISYSDGDQCESNPCLNGGSCKDDINSYECHCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1129 - protein, 415 aa, Homo sapiens
  FIX_M2_P74A
YNSGKLEEFVQGNLERECMEEKCSFEEAREVFENTERTKLFWISYSDGDQCESNPCLNGGSCKDDINSYECWCAFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1130 - protein, 415 aa, Homo sapiens
  FIX_M2_P74S
YNSGKLEEFVQGNLERECMEEKCSFEEAREVFENTERTKLFWISYSDGDQCESNPCLNGGSCKDDINSYECWCSFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1131 - protein, 415 aa, Homo sapiens
  FIX_M2_F75I
YNSGKLEEFVQGNLERECMEEKCSFEEAREVFENTERTKLFWISYSDGDQCESNPCLNGGSCKDDINSYECWCPIGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1132 - protein, 415 aa, Homo sapiens
  FIX_M2_F75V
YNSGKLEEFVQGNLERECMEEKCSFEEAREVFENTERTKLFWISYSDGDQCESNPCLNGGSCKDDINSYECWCPVGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1133 - protein, 415 aa, Homo sapiens
  FIX_M2_F77I
YNSGKLEEFVQGNLERECMEEKCSFEEAREVFENTERTKLFWISYSDGDQCESNPCLNGGSCKDDINSYECWCPFGIEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1134 - protein, 415 aa, Homo sapiens
  FIX_M2_F77V
YNSGKLEEFVQGNLERECMEEKCSFEEAREVFENTERTKLFWISYSDGDQCESNPCLNGGSCKDDINSYECWCPFGVEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1135 - protein, 415 aa, Homo sapiens
  FIX_M2_E78Q
YNSGKLEEFVQGNLERECMEEKCSFEEAREVFENTERTKLFWISYSDGDQCESNPCLNGGSCKDDINSYECWCPFGFQGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1136 - protein, 415 aa, Homo sapiens
  FIX_M2_E78H
YNSGKLEEFVQGNLERECMEEKCSFEEAREVFENTERTKLFWISYSDGDQCESNPCLNGGSCKDDINSYECWCPFGFHGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1137 - protein, 415 aa, Homo sapiens
  FIX_M2_E78N
YNSGKLEEFVQGNLERECMEEKCSFEEAREVFENTERTKLFWISYSDGDQCESNPCLNGGSCKDDINSYECWCPFGFNGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1138 - protein, 415 aa, Homo sapiens
  FIX_M2_K80N
YNSGKLEEFVQGNLERECMEEKCSFEEAREVFENTERTKLFWISYSDGDQCESNPCLNGGSCKDDINSYECWCPFGFEGNNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1139 - protein, 415 aa, Homo sapiens
  FIX_M2_K80Q
YNSGKLEEFVQGNLERECMEEKCSFEEAREVFENTERTKLFWISYSDGDQCESNPCLNGGSCKDDINSYECWCPFGFEGQNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1140 - protein, 415 aa, Homo sapiens
  FIX_M2_E83Q
YNSGKLEEFVQGNLERECMEEKCSFEEAREVFENTERTKLFWISYSDGDQCESNPCLNGGSCKDDINSYECWCPFGFEGKNCQLDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1141 - protein, 415 aa, Homo sapiens
  FIX_M2_E83H
YNSGKLEEFVQGNLERECMEEKCSFEEAREVFENTERTKLFWISYSDGDQCESNPCLNGGSCKDDINSYECWCPFGFEGKNCHLDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1142 - protein, 415 aa, Homo sapiens
  FIX_M2_E83N
YNSGKLEEFVQGNLERECMEEKCSFEEAREVFENTERTKLFWISYSDGDQCESNPCLNGGSCKDDINSYECWCPFGFEGKNCNLDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1143 - protein, 415 aa, Homo sapiens
  FIX_M2_L84I
YNSGKLEEFVQGNLERECMEEKCSFEEAREVFENTERTKLFWISYSDGDQCESNPCLNGGSCKDDINSYECWCPFGFEGKNCEIDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1144 - protein, 415 aa, Homo sapiens
  FIX_M2_L84V
YNSGKLEEFVQGNLERECMEEKCSFEEAREVFENTERTKLFWISYSDGDQCESNPCLNGGSCKDDINSYECWCPFGFEGKNCEVDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1145 - protein, 415 aa, Homo sapiens
  FIX_M2_D85N
YNSGKLEEFVQGNLERECMEEKCSFEEAREVFENTERTKLFWISYSDGDQCESNPCLNGGSCKDDINSYECWCPFGFEGKNCELNVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1146 - protein, 415 aa, Homo sapiens
  FIX_M2_D85Q
YNSGKLEEFVQGNLERECMEEKCSFEEAREVFENTERTKLFWISYSDGDQCESNPCLNGGSCKDDINSYECWCPFGFEGKNCELQVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1147 - protein, 415 aa, Homo sapiens
  FIX_M2_K91N
YNSGKLEEFVQGNLERECMEEKCSFEEAREVFENTERTKLFWISYSDGDQCESNPCLNGGSCKDDINSYECWCPFGFEGKNCELDVTCNINNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1148 - protein, 415 aa, Homo sapiens
  FIX_M2_K91Q
YNSGKLEEFVQGNLERECMEEKCSFEEAREVFENTERTKLFWISYSDGDQCESNPCLNGGSCKDDINSYECWCPFGFEGKNCELDVTCNIQNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1149 - protein, 415 aa, Homo sapiens
  FIX_M2_N92Q
YNSGKLEEFVQGNLERECMEEKCSFEEAREVFENTERTKLFWISYSDGDQCESNPCLNGGSCKDDINSYECWCPFGFEGKNCELDVTCNIKQGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1150 - protein, 415 aa, Homo sapiens
  FIX_M2_N92S
YNSGKLEEFVQGNLERECMEEKCSFEEAREVFENTERTKLFWISYSDGDQCESNPCLNGGSCKDDINSYECWCPFGFEGKNCELDVTCNIKSGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1151 - protein, 415 aa, Homo sapiens
  FIX_M2_R94H
YNSGKLEEFVQGNLERECMEEKCSFEEAREVFENTERTKLFWISYSDGDQCESNPCLNGGSCKDDINSYECWCPFGFEGKNCELDVTCNIKNGHCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1152 - protein, 415 aa, Homo sapiens
  FIX_M2_R94Q
YNSGKLEEFVQGNLERECMEEKCSFEEAREVFENTERTKLFWISYSDGDQCESNPCLNGGSCKDDINSYECWCPFGFEGKNCELDVTCNIKNGQCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1153 - protein, 415 aa, Homo sapiens
  FIX_M2_E96Q
YNSGKLEEFVQGNLERECMEEKCSFEEAREVFENTERTKLFWISYSDGDQCESNPCLNGGSCKDDINSYECWCPFGFEGKNCELDVTCNIKNGRCQQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1154 - protein, 415 aa, Homo sapiens
  FIX_M2_E96H
YNSGKLEEFVQGNLERECMEEKCSFEEAREVFENTERTKLFWISYSDGDQCESNPCLNGGSCKDDINSYECWCPFGFEGKNCELDVTCNIKNGRCHQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1155 - protein, 415 aa, Homo sapiens
  FIX_M2_E96N
YNSGKLEEFVQGNLERECMEEKCSFEEAREVFENTERTKLFWISYSDGDQCESNPCLNGGSCKDDINSYECWCPFGFEGKNCELDVTCNIKNGRCNQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1156 - protein, 415 aa, Homo sapiens
  FIX_M2_F98I
YNSGKLEEFVQGNLERECMEEKCSFEEAREVFENTERTKLFWISYSDGDQCESNPCLNGGSCKDDINSYECWCPFGFEGKNCELDVTCNIKNGRCEQICKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1157 - protein, 415 aa, Homo sapiens
  FIX_M2_F98V
YNSGKLEEFVQGNLERECMEEKCSFEEAREVFENTERTKLFWISYSDGDQCESNPCLNGGSCKDDINSYECWCPFGFEGKNCELDVTCNIKNGRCEQVCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1158 - protein, 415 aa, Homo sapiens
  FIX_M2_K100N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCNNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1159 - protein, 415 aa, Homo sapiens
  FIX_M2_K100Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCQNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1160 - protein, 415 aa, Homo sapiens
  FIX_M2_D104N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSANNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1161 - protein, 415 aa, Homo sapiens
  FIX_M2_D104Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSAQNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1162 - protein, 415 aa, Homo sapiens
  FIX_M2_K106N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNNVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1163 - protein, 415 aa, Homo sapiens
  FIX_M2_K106Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNQVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1164 - protein, 415 aa, Homo sapiens
  FIX_M2_E113Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTQGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1165 - protein, 415 aa, Homo sapiens
  FIX_M2_E113H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTHGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1166 - protein, 415 aa, Homo sapiens
  FIX_M2_E113N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTNGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1167 - protein, 415 aa, Homo sapiens
  FIX_M2_Y115H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGHRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1168 - protein, 415 aa, Homo sapiens
  FIX_M2_Y115I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGIRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1169 - protein, 415 aa, Homo sapiens
  FIX_M2_R116H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYHLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1170 - protein, 415 aa, Homo sapiens
  FIX_M2_R116Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYQLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1171 - protein, 415 aa, Homo sapiens
  FIX_M2_L117I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRIAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1172 - protein, 415 aa, Homo sapiens
  FIX_M2_L117V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRVAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1173 - protein, 415 aa, Homo sapiens
  FIX_M2_E119Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAQNQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1174 - protein, 415 aa, Homo sapiens
  FIX_M2_E119H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAHNQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1175 - protein, 415 aa, Homo sapiens
  FIX_M2_E119N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLANNQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1176 - protein, 415 aa, Homo sapiens
  FIX_M2_K122N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQNSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1177 - protein, 415 aa, Homo sapiens
  FIX_M2_K122Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQQSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1178 - protein, 415 aa, Homo sapiens
  FIX_M2_E125Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCQPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1179 - protein, 415 aa, Homo sapiens
  FIX_M2_E125H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCHPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1180 - protein, 415 aa, Homo sapiens
  FIX_M2_E125N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCNPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1181 - protein, 415 aa, Homo sapiens
  FIX_M2_P126A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEAAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1182 - protein, 415 aa, Homo sapiens
  FIX_M2_P126S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCESAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1183 - protein, 415 aa, Homo sapiens
  FIX_M2_P129A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVAFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1184 - protein, 415 aa, Homo sapiens
  FIX_M2_P129S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVSFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1185 - protein, 415 aa, Homo sapiens
  FIX_M2_P131A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFACGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1186 - protein, 415 aa, Homo sapiens
  FIX_M2_P131S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFSCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1187 - protein, 415 aa, Homo sapiens
  FIX_M2_R134H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGHVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1188 - protein, 415 aa, Homo sapiens
  FIX_M2_R134Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGQVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1189 - protein, 415 aa, Homo sapiens
  FIX_M2_K142N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSNLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1190 - protein, 415 aa, Homo sapiens
  FIX_M2_K142Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSQLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1191 - protein, 415 aa, Homo sapiens
  FIX_M2_L143I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKITRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1192 - protein, 415 aa, Homo sapiens
  FIX_M2_L143V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKVTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1193 - protein, 415 aa, Homo sapiens
  FIX_M2_R145H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTHAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1194 - protein, 415 aa, Homo sapiens
  FIX_M2_R145Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTQAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1195 - protein, 415 aa, Homo sapiens
  FIX_M2_E147Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAQTVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1196 - protein, 415 aa, Homo sapiens
  FIX_M2_E147H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAHTVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1197 - protein, 415 aa, Homo sapiens
  FIX_M2_E147N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRANTVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1198 - protein, 415 aa, Homo sapiens
  FIX_M2_P151A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFADVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1199 - protein, 415 aa, Homo sapiens
  FIX_M2_P151S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFSDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1200 - protein, 415 aa, Homo sapiens
  FIX_M2_D152N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPNVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1201 - protein, 415 aa, Homo sapiens
  FIX_M2_D152Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPQVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1202 - protein, 415 aa, Homo sapiens
  FIX_M2_D154N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVNYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1203 - protein, 415 aa, Homo sapiens
  FIX_M2_D154Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVQYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1204 - protein, 415 aa, Homo sapiens
  FIX_M2_Y155H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDHVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1205 - protein, 415 aa, Homo sapiens
  FIX_M2_Y155I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDIVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1206 - protein, 415 aa, Homo sapiens
  FIX_M2_E160Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTQAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1207 - protein, 415 aa, Homo sapiens
  FIX_M2_E160H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTHAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1208 - protein, 415 aa, Homo sapiens
  FIX_M2_E160N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTNAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1209 - protein, 415 aa, Homo sapiens
  FIX_M2_E162Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAQTILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1210 - protein, 415 aa, Homo sapiens
  FIX_M2_E162H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAHTILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1211 - protein, 415 aa, Homo sapiens
  FIX_M2_E162N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEANTILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1212 - protein, 415 aa, Homo sapiens
  FIX_M2_L165I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETIIDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1213 - protein, 415 aa, Homo sapiens
  FIX_M2_L165V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETIVDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1214 - protein, 415 aa, Homo sapiens
  FIX_M2_D166N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1215 - protein, 415 aa, Homo sapiens
  FIX_M2_D166Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1216 - protein, 415 aa, Homo sapiens
  FIX_M2_F175I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSINDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1217 - protein, 415 aa, Homo sapiens
  FIX_M2_F175V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSVNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1218 - protein, 415 aa, Homo sapiens
  FIX_M2_D177N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNNFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1219 - protein, 415 aa, Homo sapiens
  FIX_M2_D177Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNQFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1220 - protein, 415 aa, Homo sapiens
  FIX_M2_F178I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDITRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1221 - protein, 415 aa, Homo sapiens
  FIX_M2_F178V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDVTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1222 - protein, 415 aa, Homo sapiens
  FIX_M2_R180H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTHVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1223 - protein, 415 aa, Homo sapiens
  FIX_M2_R180Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTQVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1224 - protein, 415 aa, Homo sapiens
  FIX_M2_E185Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGQDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1225 - protein, 415 aa, Homo sapiens
  FIX_M2_E185H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGHDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1226 - protein, 415 aa, Homo sapiens
  FIX_M2_E185N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGNDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1227 - protein, 415 aa, Homo sapiens
  FIX_M2_D186N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGENAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1228 - protein, 415 aa, Homo sapiens
  FIX_M2_D186Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEQAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1229 - protein, 415 aa, Homo sapiens
  FIX_M2_K188N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDANPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1230 - protein, 415 aa, Homo sapiens
  FIX_M2_K188Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAQPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1231 - protein, 415 aa, Homo sapiens
  FIX_M2_P189A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKAGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1232 - protein, 415 aa, Homo sapiens
  FIX_M2_P189S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKSGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1233 - protein, 415 aa, Homo sapiens
  FIX_M2_P193A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFAWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1234 - protein, 415 aa, Homo sapiens
  FIX_M2_P193S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFSWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1235 - protein, 415 aa, Homo sapiens
  FIX_M2_W194S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPSQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1236 - protein, 415 aa, Homo sapiens
  FIX_M2_W194H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPHQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1237 - protein, 415 aa, Homo sapiens
  FIX_M2_L198I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVINGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1238 - protein, 415 aa, Homo sapiens
  FIX_M2_L198V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVVNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1239 - protein, 415 aa, Homo sapiens
  FIX_M2_N199Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLQGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1240 - protein, 415 aa, Homo sapiens
  FIX_M2_N199S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLSGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1241 - protein, 415 aa, Homo sapiens
  FIX_M2_K201N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGNVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1242 - protein, 415 aa, Homo sapiens
  FIX_M2_K201Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGQVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1243 - protein, 415 aa, Homo sapiens
  FIX_M2_D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1244 - protein, 415 aa, Homo sapiens
  FIX_M2_D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1245 - protein, 415 aa, Homo sapiens
  FIX_M2_F205I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAICGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1246 - protein, 415 aa, Homo sapiens
  FIX_M2_F205V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAVCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1247 - protein, 415 aa, Homo sapiens
  FIX_M2_E213Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNQKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1248 - protein, 415 aa, Homo sapiens
  FIX_M2_E213H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNHKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1249 - protein, 415 aa, Homo sapiens
  FIX_M2_E213N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNNKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1250 - protein, 415 aa, Homo sapiens
  FIX_M2_K214N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNENWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1251 - protein, 415 aa, Homo sapiens
  FIX_M2_K214Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEQWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1252 - protein, 415 aa, Homo sapiens
  FIX_M2_W215S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKSIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1253 - protein, 415 aa, Homo sapiens
  FIX_M2_W215H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKHIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1254 - protein, 415 aa, Homo sapiens
  FIX_M2_E224Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVQTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1255 - protein, 415 aa, Homo sapiens
  FIX_M2_E224H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVHTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1256 - protein, 415 aa, Homo sapiens
  FIX_M2_E224N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVNTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1257 - protein, 415 aa, Homo sapiens
  FIX_M2_K228N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1258 - protein, 415 aa, Homo sapiens
  FIX_M2_K228Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVQITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1259 - protein, 415 aa, Homo sapiens
  FIX_M2_E235Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGQHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1260 - protein, 415 aa, Homo sapiens
  FIX_M2_E235H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGHHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1261 - protein, 415 aa, Homo sapiens
  FIX_M2_E235N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGNHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1262 - protein, 415 aa, Homo sapiens
  FIX_M2_E239Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIQETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1263 - protein, 415 aa, Homo sapiens
  FIX_M2_E239H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIHETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1264 - protein, 415 aa, Homo sapiens
  FIX_M2_E239N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNINETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1265 - protein, 415 aa, Homo sapiens
  FIX_M2_E240Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEQTEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1266 - protein, 415 aa, Homo sapiens
  FIX_M2_E240H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEHTEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1267 - protein, 415 aa, Homo sapiens
  FIX_M2_E240N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIENTEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1268 - protein, 415 aa, Homo sapiens
  FIX_M2_E242Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETQHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1269 - protein, 415 aa, Homo sapiens
  FIX_M2_E242H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETHHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1270 - protein, 415 aa, Homo sapiens
  FIX_M2_E242N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETNHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1271 - protein, 415 aa, Homo sapiens
  FIX_M2_E245Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTQQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1272 - protein, 415 aa, Homo sapiens
  FIX_M2_E245H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTHQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1273 - protein, 415 aa, Homo sapiens
  FIX_M2_E245N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTNQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1274 - protein, 415 aa, Homo sapiens
  FIX_M2_K247N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1275 - protein, 415 aa, Homo sapiens
  FIX_M2_K247Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQQRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1276 - protein, 415 aa, Homo sapiens
  FIX_M2_R248H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKHNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1277 - protein, 415 aa, Homo sapiens
  FIX_M2_R248Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKQNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1278 - protein, 415 aa, Homo sapiens
  FIX_M2_R252H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIHIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1279 - protein, 415 aa, Homo sapiens
  FIX_M2_R252Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIQIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1280 - protein, 415 aa, Homo sapiens
  FIX_M2_P255A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIAHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1281 - protein, 415 aa, Homo sapiens
  FIX_M2_P255S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIISHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1282 - protein, 415 aa, Homo sapiens
  FIX_M2_Y259H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNHNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1283 - protein, 415 aa, Homo sapiens
  FIX_M2_Y259I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNINAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1284 - protein, 415 aa, Homo sapiens
  FIX_M2_K265N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINNYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1285 - protein, 415 aa, Homo sapiens
  FIX_M2_K265Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINQYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1286 - protein, 415 aa, Homo sapiens
  FIX_M2_Y266H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKHNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1287 - protein, 415 aa, Homo sapiens
  FIX_M2_Y266I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKINHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1288 - protein, 415 aa, Homo sapiens
  FIX_M2_D269N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHNIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1289 - protein, 415 aa, Homo sapiens
  FIX_M2_D269Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHQIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1290 - protein, 415 aa, Homo sapiens
  FIX_M2_L272I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIAILELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1291 - protein, 415 aa, Homo sapiens
  FIX_M2_L272V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIAVLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1292 - protein, 415 aa, Homo sapiens
  FIX_M2_L273I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALIELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1293 - protein, 415 aa, Homo sapiens
  FIX_M2_L273V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALVELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1294 - protein, 415 aa, Homo sapiens
  FIX_M2_E274Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLQLDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1295 - protein, 415 aa, Homo sapiens
  FIX_M2_E274H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLHLDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1296 - protein, 415 aa, Homo sapiens
  FIX_M2_E274N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLNLDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1297 - protein, 415 aa, Homo sapiens
  FIX_M2_L275I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLEIDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1298 - protein, 415 aa, Homo sapiens
  FIX_M2_L275V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLEVDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1299 - protein, 415 aa, Homo sapiens
  FIX_M2_D276N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELNEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1300 - protein, 415 aa, Homo sapiens
  FIX_M2_D276Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELQEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1301 - protein, 415 aa, Homo sapiens
  FIX_M2_E277Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDQPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1302 - protein, 415 aa, Homo sapiens
  FIX_M2_E277H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDHPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1303 - protein, 415 aa, Homo sapiens
  FIX_M2_E277N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDNPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1304 - protein, 415 aa, Homo sapiens
  FIX_M2_P278A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEALVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1305 - protein, 415 aa, Homo sapiens
  FIX_M2_P278S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDESLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1306 - protein, 415 aa, Homo sapiens
  FIX_M2_L279I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPIVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1307 - protein, 415 aa, Homo sapiens
  FIX_M2_L279V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPVVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1308 - protein, 415 aa, Homo sapiens
  FIX_M2_L281I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVINSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1309 - protein, 415 aa, Homo sapiens
  FIX_M2_L281V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVVNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1310 - protein, 415 aa, Homo sapiens
  FIX_M2_Y284H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSHVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1311 - protein, 415 aa, Homo sapiens
  FIX_M2_Y284I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSIVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1312 - protein, 415 aa, Homo sapiens
  FIX_M2_P287A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTAICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1313 - protein, 415 aa, Homo sapiens
  FIX_M2_P287S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTSICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1314 - protein, 415 aa, Homo sapiens
  FIX_M2_D292N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIANKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1315 - protein, 415 aa, Homo sapiens
  FIX_M2_D292Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIAQKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1316 - protein, 415 aa, Homo sapiens
  FIX_M2_K293N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADNEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1317 - protein, 415 aa, Homo sapiens
  FIX_M2_K293Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADQEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1318 - protein, 415 aa, Homo sapiens
  FIX_M2_E294Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKQYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1319 - protein, 415 aa, Homo sapiens
  FIX_M2_E294H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKHYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1320 - protein, 415 aa, Homo sapiens
  FIX_M2_E294N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKNYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1321 - protein, 415 aa, Homo sapiens
  FIX_M2_Y295H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEHTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1322 - protein, 415 aa, Homo sapiens
  FIX_M2_Y295I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEITNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1323 - protein, 415 aa, Homo sapiens
  FIX_M2_F299I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIILKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1324 - protein, 415 aa, Homo sapiens
  FIX_M2_F299V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIVLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1325 - protein, 415 aa, Homo sapiens
  FIX_M2_L300I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFIKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1326 - protein, 415 aa, Homo sapiens
  FIX_M2_L300V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFVKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1327 - protein, 415 aa, Homo sapiens
  FIX_M2_K301N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLNFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1328 - protein, 415 aa, Homo sapiens
  FIX_M2_K301Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLQFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1329 - protein, 415 aa, Homo sapiens
  FIX_M2_F302I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKIGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1330 - protein, 415 aa, Homo sapiens
  FIX_M2_F302V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKVGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1331 - protein, 415 aa, Homo sapiens
  FIX_M2_Y306H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGHVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1332 - protein, 415 aa, Homo sapiens
  FIX_M2_Y306I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGIVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1333 - protein, 415 aa, Homo sapiens
  FIX_M2_W310S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGSGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1334 - protein, 415 aa, Homo sapiens
  FIX_M2_W310H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGHGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1335 - protein, 415 aa, Homo sapiens
  FIX_M2_R312H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGHVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1336 - protein, 415 aa, Homo sapiens
  FIX_M2_R312Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGQVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1337 - protein, 415 aa, Homo sapiens
  FIX_M2_F314I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVIHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1338 - protein, 415 aa, Homo sapiens
  FIX_M2_F314V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVVHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1339 - protein, 415 aa, Homo sapiens
  FIX_M2_K316N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHNGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1340 - protein, 415 aa, Homo sapiens
  FIX_M2_K316Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHQGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1341 - protein, 415 aa, Homo sapiens
  FIX_M2_R318H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGHSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1342 - protein, 415 aa, Homo sapiens
  FIX_M2_R318Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGQSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1343 - protein, 415 aa, Homo sapiens
  FIX_M2_L321I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSAIVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1344 - protein, 415 aa, Homo sapiens
  FIX_M2_L321V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSAVVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1345 - protein, 415 aa, Homo sapiens
  FIX_M2_L323I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVIQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1346 - protein, 415 aa, Homo sapiens
  FIX_M2_L323V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVVQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1347 - protein, 415 aa, Homo sapiens
  FIX_M2_Y325H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQHLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1348 - protein, 415 aa, Homo sapiens
  FIX_M2_Y325I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQILRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1349 - protein, 415 aa, Homo sapiens
  FIX_M2_L326I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYIRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1350 - protein, 415 aa, Homo sapiens
  FIX_M2_L326V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYVRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1351 - protein, 415 aa, Homo sapiens
  FIX_M2_R327H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLHVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1352 - protein, 415 aa, Homo sapiens
  FIX_M2_R327Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLQVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1353 - protein, 415 aa, Homo sapiens
  FIX_M2_P329A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVALVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1354 - protein, 415 aa, Homo sapiens
  FIX_M2_P329S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVSLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1355 - protein, 415 aa, Homo sapiens
  FIX_M2_L330I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPIVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1356 - protein, 415 aa, Homo sapiens
  FIX_M2_L330V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPVVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1357 - protein, 415 aa, Homo sapiens
  FIX_M2_D332N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVNRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1358 - protein, 415 aa, Homo sapiens
  FIX_M2_D332Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVQRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1359 - protein, 415 aa, Homo sapiens
  FIX_M2_R333H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDHATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1360 - protein, 415 aa, Homo sapiens
  FIX_M2_R333Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDQATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1361 - protein, 415 aa, Homo sapiens
  FIX_M2_L337I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCIRSTKFTIYNNMFCAGFHEGGRDSCQGDSGGPHVTEVEGTSFLTGIISWGEECAMKGKYGIYTKVSRYVNWIKEKTKLT

SEQ ID NO: 1362 - protein, 415 aa, Homo sapiens
  FIX_M2_L337V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCVRSTKFTIYNNMFCAGFHEGGRDSCQGDSGGPHVTEVEGTSFLTGIISWGEECAMKGKYGIYTKVSRYVNWIKEKTKLT

SEQ ID NO: 1363 - protein, 415 aa, Homo sapiens
  FIX_M2_R338H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLHSTKFTIYNNMFCAGFHEGGRDSCQGDSGGPHVTEVEGTSFLTGIISWGEECAMKGKYGIYTKVSRYVNWIKEKTKLT

SEQ ID NO: 1364 - protein, 415 aa, Homo sapiens
  FIX_M2_R338Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLQSTKFTIYNNMFCAGFHEGGRDSCQGDSGGPHVTEVEGTSFLTGIISWGEECAMKGKYGIYTKVSRYVNWIKEKTKLT

SEQ ID NO: 1365 - protein, 415 aa, Homo sapiens
  FIX_M2_K341N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTNFTIYNNMFCAGFHEGGRDSCQGDSGGPHVTEVEGTSFLTGIISWGEECAMKGKYGIYTKVSRYVNWIKEKTKLT

SEQ ID NO: 1366 - protein, 415 aa, Homo sapiens
  FIX_M2_K341Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTQFTIYNNMFCAGFHEGGRDSCQGDSGGPHVTEVEGTSFLTGIISWGEECAMKGKYGIYTKVSRYVNWIKEKTKLT

SEQ ID NO: 1367 - protein, 415 aa, Homo sapiens
  FIX_M2_F342I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKITIYNNMFCAGFHEGGRDSCQGDSGGPHVTEVEGTSFLTGIISWGEECAMKGKYGIYTKVSRYVNWIKEKTKLT

SEQ ID NO: 1368 - protein, 415 aa, Homo sapiens
  FIX_M2_F342V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKVTIYNNMFCAGFHEGGRDSCQGDSGGPHVTEVEGTSFLTGIISWGEECAMKGKYGIYTKVSRYVNWIKEKTKLT

SEQ ID NO: 1369 - protein, 415 aa, Homo sapiens
  FIX_M2_Y345H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIHNNMFCAGFHEGGRDSCQGDSGGPHVTEVEGTSFLTGIISWGEECAMKGKYGIYTKVSRYVNWIKEKTKLT

SEQ ID NO: 1370 - protein, 415 aa, Homo sapiens
  FIX_M2_Y345I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIINNMFCAGFHEGGRDSCQGDSGGPHVTEVEGTSFLTGIISWGEECAMKGKYGIYTKVSRYVNWIKEKTKLT

SEQ ID NO: 1371 - protein, 415 aa, Homo sapiens
  FIX_M2_M348I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNIFCAGFHEGGRDSCQGDSGGPHVTEVEGTSFLTGIISWGEECAMKGKYGIYTKVSRYVNWIKEKTKLT

SEQ ID NO: 1372 - protein, 415 aa, Homo sapiens
  FIX_M2_M348V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNVFCAGFHEGGRDSCQGDSGGPHVTEVEGTSFLTGIISWGEECAMKGKYGIYTKVSRYVNWIKEKTKLT

SEQ ID NO: 1373 - protein, 415 aa, Homo sapiens
  FIX_M2_F349I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMICAGFHEGGRDSCQGDSGGPHVTEVEGTSFLTGIISWGEECAMKGKYGIYTKVSRYVNWIKEKTKLT

SEQ ID NO: 1374 - protein, 415 aa, Homo sapiens
  FIX_M2_F349V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMVCAGFHEGGRDSCQGDSGGPHVTEVEGTSFLTGIISWGEECAMKGKYGIYTKVSRYVNWIKEKTKLT

SEQ ID NO: 1375 - protein, 415 aa, Homo sapiens
  FIX_M2_F353I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGIHEGGRDSCQGDSGGPHVTEVEGTSFLTGIISWGEECAMKGKYGIYTKVSRYVNWIKEKTKLT

SEQ ID NO: 1376 - protein, 415 aa, Homo sapiens
  FIX_M2_F353V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGVHEGGRDSCQGDSGGPHVTEVEGTSFLTGIISWGEECAMKGKYGIYTKVSRYVNWIKEKTKLT

SEQ ID NO: 1377 - protein, 415 aa, Homo sapiens
  FIX_M2_E355Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHQGGRDSCQGDSGGPHVTEVEGTSFLTGIISWGEECAMKGKYGIYTKVSRYVNWIKEKTKLT

SEQ ID NO: 1378 - protein, 415 aa, Homo sapiens
  FIX_M2_E355H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHHGGRDSCQGDSGGPHVTEVEGTSFLTGIISWGEECAMKGKYGIYTKVSRYVNWIKEKTKLT

SEQ ID NO: 1379 - protein, 415 aa, Homo sapiens
  FIX_M2_E355N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHNGGRDSCQGDSGGPHVTEVEGTSFLTGIISWGEECAMKGKYGIYTKVSRYVNWIKEKTKLT

SEQ ID NO: 1380 - protein, 415 aa, Homo sapiens
  FIX_M2_R358H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGHDSCQGDSGGPHVTEVEGTSFLTGIISWGEECAMKGKYGIYTKVSRYVNWIKEKTKLT

SEQ ID NO: 1381 - protein, 415 aa, Homo sapiens
  FIX_M2_R358Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGQDSCQGDSGGPHVTEVEGTSFLTGIISWGEECAMKGKYGIYTKVSRYVNWIKEKTKLT

SEQ ID NO: 1382 - protein, 415 aa, Homo sapiens
  FIX_M2_D359N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRNSCQGDSGGPHVTEVEGTSFLTGIISWGEECAMKGKYGIYTKVSRYVNWIKEKTKLT

SEQ ID NO: 1383 - protein, 415 aa, Homo sapiens
  FIX_M2_D359Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRQSCQGDSGGPHVTEVEGTSFLTGIISWGEECAMKGKYGIYTKVSRYVNWIKEKTKLT

SEQ ID NO: 1384 - protein, 415 aa, Homo sapiens
  FIX_M2_D364N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGNSGGPHVTEVEGTSFLTGIISWGEECAMKGKYGIYTKVSRYVNWIKEKTKLT

SEQ ID NO: 1385 - protein, 415 aa, Homo sapiens
  FIX_M2_D364Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGQSGGPHVTEVEGTSFLTGIISWGEECAMKGKYGIYTKVSRYVNWIKEKTKLT

SEQ ID NO: 1386 - protein, 415 aa, Homo sapiens
  FIX_M2_P368A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGAHVTEVEGTSFLTGIISWGEECAMKGKYGIYTKVSRYVNWIKEKTKLT

SEQ ID NO: 1387 - protein, 415 aa, Homo sapiens
  FIX_M2_P368S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGSHVTEVEGTSFLTGIISWGEECAMKGKYGIYTKVSRYVNWIKEKTKLT

SEQ ID NO: 1388 - protein, 415 aa, Homo sapiens
  FIX_M2_E372Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTQVEGTSFLTGIISWGEECAMKGKYGIYTKVSRYVNWIKEKTKLT

SEQ ID NO: 1389 - protein, 415 aa, Homo sapiens
  FIX_M2_E372H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTHVEGTSFLTGIISWGEECAMKGKYGIYTKVSRYVNWIKEKTKLT

SEQ ID NO: 1390 - protein, 415 aa, Homo sapiens
  FIX_M2_E372N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTNVEGTSFLTGIISWGEECAMKGKYGIYTKVSRYVNWIKEKTKLT

SEQ ID NO: 1391 - protein, 415 aa, Homo sapiens
  FIX_M2_E374Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVQGTSFLTGIISWGEECAMKGKYGIYTKVSRYVNWIKEKTKLT

SEQ ID NO: 1392 - protein, 415 aa, Homo sapiens
  FIX_M2_E374H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVHGTSFLTGIISWGEECAMKGKYGIYTKVSRYVNWIKEKTKLT

SEQ ID NO: 1393 - protein, 415 aa, Homo sapiens
  FIX_M2_E374N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVNGTSFLTGIISWGEECAMKGKYGIYTKVSRYVNWIKEKTKLT

SEQ ID NO: 1394 - protein, 415 aa, Homo sapiens
  FIX_M2_F378I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSILTGIISWGEECAMKGKYGIYTKVSRYVNWIKEKTKLT

SEQ ID NO: 1395 - protein, 415 aa, Homo sapiens
  FIX_M2_F378V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSVLTGIISWGEECAMKGKYGIYTKVSRYVNWIKEKTKLT

SEQ ID NO: 1396 - protein, 415 aa, Homo sapiens
  FIX_M2_L379I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFITGIISWGEECAMKGKYGIYTKVSRYVNWIKEKTKLT

SEQ ID NO: 1397 - protein, 415 aa, Homo sapiens
  FIX_M2_L379V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFVTGIISWGEECAMKGKYGIYTKVSRYVNWIKEKTKLT

SEQ ID NO: 1398 - protein, 415 aa, Homo sapiens
  FIX_M2_W385S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISSGEECAMKGKYGIYTKVSRYVNWIKEKTKLT

SEQ ID NO: 1399 - protein, 415 aa, Homo sapiens
  FIX_M2_W385H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISHGEECAMKGKYGIYTKVSRYVNWIKEKTKLT

SEQ ID NO: 1400 - protein, 415 aa, Homo sapiens
  FIX_M2_E387Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGQECAMKGKYGIYTKVSRYVNWIKEKTKLT

SEQ ID NO: 1401 - protein, 415 aa, Homo sapiens
  FIX_M2_E387H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGHECAMKGKYGIYTKVSRYVNWIKEKTKLT

SEQ ID NO: 1402 - protein, 415 aa, Homo sapiens
  FIX_M2_E387N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGNECAMKGKYGIYTKVSRYVNWIKEKTKLT

SEQ ID NO: 1403 - protein, 415 aa, Homo sapiens
  FIX_M2_E388Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEQCAMKGKYGIYTKVSRYVNWIKEKTKLT

SEQ ID NO: 1404 - protein, 415 aa, Homo sapiens
  FIX_M2_E388H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEHCAMKGKYGIYTKVSRYVNWIKEKTKLT

SEQ ID NO: 1405 - protein, 415 aa, Homo sapiens
  FIX_M2_E388N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGENCAMKGKYGIYTKVSRYVNWIKEKTKLT

SEQ ID NO: 1406 - protein, 415 aa, Homo sapiens
  FIX_M2_M391I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAIKGKYGIYTKVSRYVNWIKEKTKLT

SEQ ID NO: 1407 - protein, 415 aa, Homo sapiens
  FIX_M2_M391V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAVKGKYGIYTKVSRYVNWIKEKTKLT

SEQ ID NO: 1408 - protein, 415 aa, Homo sapiens
  FIX_M2_K392N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMNGKYGIYTKVSRYVNWIKEKTKLT

SEQ ID NO: 1409 - protein, 415 aa, Homo sapiens
  FIX_M2_K392Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMQGKYGIYTKVSRYVNWIKEKTKLT

SEQ ID NO: 1410 - protein, 415 aa, Homo sapiens
  FIX_M2_K394N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGNYGIYTKVSRYVNWIKEKTKLT

SEQ ID NO: 1411 - protein, 415 aa, Homo sapiens
  FIX_M2_K394Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGQYGIYTKVSRYVNWIKEKTKLT

SEQ ID NO: 1412 - protein, 415 aa, Homo sapiens
  FIX_M2_Y395H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKHGIYTKVSRYVNWIKEKTKLT

SEQ ID NO: 1413 - protein, 415 aa, Homo sapiens
  FIX_M2_Y395I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKIGIYTKVSRYVNWIKEKTKLT

SEQ ID NO: 1414 - protein, 415 aa, Homo sapiens
  FIX_M2_Y398H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIHTKVSRYVNWIKEKTKLT

SEQ ID NO: 1415 - protein, 415 aa, Homo sapiens
  FIX_M2_Y398I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIITKVSRYVNWIKEKTKLT

SEQ ID NO: 1416 - protein, 415 aa, Homo sapiens
  FIX_M2_K400N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTNVSRYVNWIKEKTKLT

SEQ ID NO: 1417 - protein, 415 aa, Homo sapiens
  FIX_M2_K400Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTQVSRYVNWIKEKTKLT

SEQ ID NO: 1418 - protein, 415 aa, Homo sapiens
  FIX_M2_R403H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSHYVNWIKEKTKLT

SEQ ID NO: 1419 - protein, 415 aa, Homo sapiens
  FIX_M2_R403Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSQYVNWIKEKTKLT

SEQ ID NO: 1420 - protein, 415 aa, Homo sapiens
  FIX_M2_Y404H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRHVNWIKEKTKLT

SEQ ID NO: 1421 - protein, 415 aa, Homo sapiens
  FIX_M2_Y404I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRIVNWIKEKTKLT

SEQ ID NO: 1422 - protein, 415 aa, Homo sapiens
  FIX_M2_W407S
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNSIKEKTKLT

SEQ ID NO: 1423 - protein, 415 aa, Homo sapiens
  FIX_M2_W407H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNHIKEKTKLT

SEQ ID NO: 1424 - protein, 415 aa, Homo sapiens
  FIX_M2_K409N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWINEKTKLT

SEQ ID NO: 1425 - protein, 415 aa, Homo sapiens
  FIX_M2_K409Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIQEKTKLT

SEQ ID NO: 1426 - protein, 415 aa, Homo sapiens
  FIX_M2_E410Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKQKTKLT

SEQ ID NO: 1427 - protein, 415 aa, Homo sapiens
  FIX_M2_E410H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKHKTKLT

SEQ ID NO: 1428 - protein, 415 aa, Homo sapiens
  FIX_M2_E410N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKNKTKLT

SEQ ID NO: 1429 - protein, 415 aa, Homo sapiens
  FIX_M2_K411N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKENTKLT

SEQ ID NO: 1430 - protein, 415 aa, Homo sapiens
  FIX_M2_K411Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEQTKLT

SEQ ID NO: 1431 - protein, 415 aa, Homo sapiens
  FIX_M2_K413N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTNLT

SEQ ID NO: 1432 - protein, 415 aa, Homo sapiens
  FIX_M2_K413Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTQLT

SEQ ID NO: 1433 - protein, 415 aa, Homo sapiens
  FIX_M2_L414I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKIT

SEQ ID NO: 1434 - protein, 415 aa, Homo sapiens
  FIX_M2_L414V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKVT

SEQ ID NO: 1435 - protein, 415 aa, Homo sapiens
  FIX_M2_S3N
YNNGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1436 - protein, 415 aa, Homo sapiens
  FIX_M2_S3Q
YNQGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1437 - protein, 415 aa, Homo sapiens
  FIX_M2_S3H
YNHGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1438 - protein, 415 aa, Homo sapiens
  FIX_M2_G4N
YNSNKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1439 - protein, 415 aa, Homo sapiens
  FIX_M2_G4Q
YNSQKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1440 - protein, 415 aa, Homo sapiens
  FIX_M2_G4H
YNSHKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1441 - protein, 415 aa, Homo sapiens
  FIX_M2_V10N
YNSGKLEEFNQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1442 - protein, 415 aa, Homo sapiens
  FIX_M2_V10Q
YNSGKLEEFQQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1443 - protein, 415 aa, Homo sapiens
  FIX_M2_V10H
YNSGKLEEFHQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1444 - protein, 415 aa, Homo sapiens
  FIX_M2_G12N
YNSGKLEEFVQNNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1445 - protein, 415 aa, Homo sapiens
  FIX_M2_G12Q
YNSGKLEEFVQQNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1446 - protein, 415 aa, Homo sapiens
  FIX_M2_G12H
YNSGKLEEFVQHNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1447 - protein, 415 aa, Homo sapiens
  FIX_M2_S24N
YNSGKLEEFVQGNLERECMEEKCNFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1448 - protein, 415 aa, Homo sapiens
  FIX_M2_S24Q
YNSGKLEEFVQGNLERECMEEKCQFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1449 - protein, 415 aa, Homo sapiens
  FIX_M2_S24H
YNSGKLEEFVQGNLERECMEEKCHFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1450 - protein, 415 aa, Homo sapiens
  FIX_M2_A28N
YNSGKLEEFVQGNLERECMEEKCSFEENREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1451 - protein, 415 aa, Homo sapiens
  FIX_M2_A28Q
YNSGKLEEFVQGNLERECMEEKCSFEEQREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1452 - protein, 415 aa, Homo sapiens
  FIX_M2_A28H
YNSGKLEEFVQGNLERECMEEKCSFEEHREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1453 - protein, 415 aa, Homo sapiens
  FIX_M2_V31N
YNSGKLEEFVQGNLERECMEEKCSFEEARENFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1454 - protein, 415 aa, Homo sapiens
  FIX_M2_V31Q
YNSGKLEEFVQGNLERECMEEKCSFEEAREQFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1455 - protein, 415 aa, Homo sapiens
  FIX_M2_V31H
YNSGKLEEFVQGNLERECMEEKCSFEEAREHFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1456 - protein, 415 aa, Homo sapiens
  FIX_M2_T35N
YNSGKLEEFVQGNLERECMEEKCSFEEAREVFENNERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1457 - protein, 415 aa, Homo sapiens
  FIX_M2_T35Q
YNSGKLEEFVQGNLERECMEEKCSFEEAREVFENQERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1458 - protein, 415 aa, Homo sapiens
  FIX_M2_T35H
YNSGKLEEFVQGNLERECMEEKCSFEEAREVFENHERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1459 - protein, 415 aa, Homo sapiens
  FIX_M2_T38N
YNSGKLEEFVQGNLERECMEEKCSFEEAREVFENTERNKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1460 - protein, 415 aa, Homo sapiens
  FIX_M2_T38Q
YNSGKLEEFVQGNLERECMEEKCSFEEAREVFENTERQKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1461 - protein, 415 aa, Homo sapiens
  FIX_M2_T38H
YNSGKLEEFVQGNLERECMEEKCSFEEAREVFENTERHKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1462 - protein, 415 aa, Homo sapiens
  FIX_M2_I43N
YNSGKLEEFVQGNLERECMEEKCSFEEAREVFENTERTKLFWNSYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1463 - protein, 415 aa, Homo sapiens
  FIX_M2_I43H
YNSGKLEEFVQGNLERECMEEKCSFEEAREVFENTERTKLFWHSYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1464 - protein, 415 aa, Homo sapiens
  FIX_M2_I43Q
YNSGKLEEFVQGNLERECMEEKCSFEEAREVFENTERTKLFWQSYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1465 - protein, 415 aa, Homo sapiens
  FIX_M2_S44N
YNSGKLEEFVQGNLERECMEEKCSFEEAREVFENTERTKLFWINYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1466 - protein, 415 aa, Homo sapiens
  FIX_M2_S44H
YNSGKLEEFVQGNLERECMEEKCSFEEAREVFENTERTKLFWIHYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1467 - protein, 415 aa, Homo sapiens
  FIX_M2_S44Q
YNSGKLEEFVQGNLERECMEEKCSFEEAREVFENTERTKLFWIQYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1468 - protein, 415 aa, Homo sapiens
  FIX_M2_S46N
YNSGKLEEFVQGNLERECMEEKCSFEEAREVFENTERTKLFWISYNDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1469 - protein, 415 aa, Homo sapiens
  FIX_M2_S46Q
YNSGKLEEFVQGNLERECMEEKCSFEEAREVFENTERTKLFWISYQDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1470 - protein, 415 aa, Homo sapiens
  FIX_M2_S46H
YNSGKLEEFVQGNLERECMEEKCSFEEAREVFENTERTKLFWISYHDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1471 - protein, 415 aa, Homo sapiens
  FIX_M2_G48N
YNSGKLEEFVQGNLERECMEEKCSFEEAREVFENTERTKLFWISYSDNDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1472 - protein, 415 aa, Homo sapiens
  FIX_M2_G48Q
YNSGKLEEFVQGNLERECMEEKCSFEEAREVFENTERTKLFWISYSDQDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1473 - protein, 415 aa, Homo sapiens
  FIX_M2_G48H
YNSGKLEEFVQGNLERECMEEKCSFEEAREVFENTERTKLFWISYSDHDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1474 - protein, 415 aa, Homo sapiens
  FIX_M2_S53N
YNSGKLEEFVQGNLERECMEEKCSFEEAREVFENTERTKLFWISYSDGDQCENNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1475 - protein, 415 aa, Homo sapiens
  FIX_M2_S53Q
YNSGKLEEFVQGNLERECMEEKCSFEEAREVFENTERTKLFWISYSDGDQCEQNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1476 - protein, 415 aa, Homo sapiens
  FIX_M2_S53H
YNSGKLEEFVQGNLERECMEEKCSFEEAREVFENTERTKLFWISYSDGDQCEHNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1477 - protein, 415 aa, Homo sapiens
  FIX_M2_G59N
YNSGKLEEFVQGNLERECMEEKCSFEEAREVFENTERTKLFWISYSDGDQCESNPCLNNGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1478 - protein, 415 aa, Homo sapiens
  FIX_M2_G59Q
YNSGKLEEFVQGNLERECMEEKCSFEEAREVFENTERTKLFWISYSDGDQCESNPCLNQGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1479 - protein, 415 aa, Homo sapiens
  FIX_M2_G59H
YNSGKLEEFVQGNLERECMEEKCSFEEAREVFENTERTKLFWISYSDGDQCESNPCLNHGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1480 - protein, 415 aa, Homo sapiens
  FIX_M2_G60N
YNSGKLEEFVQGNLERECMEEKCSFEEAREVFENTERTKLFWISYSDGDQCESNPCLNGNSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1481 - protein, 415 aa, Homo sapiens
  FIX_M2_G60Q
YNSGKLEEFVQGNLERECMEEKCSFEEAREVFENTERTKLFWISYSDGDQCESNPCLNGQSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1482 - protein, 415 aa, Homo sapiens
  FIX_M2_G60H
YNSGKLEEFVQGNLERECMEEKCSFEEAREVFENTERTKLFWISYSDGDQCESNPCLNGHSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1483 - protein, 415 aa, Homo sapiens
  FIX_M2_S61N
YNSGKLEEFVQGNLERECMEEKCSFEEAREVFENTERTKLFWISYSDGDQCESNPCLNGGNCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1484 - protein, 415 aa, Homo sapiens
  FIX_M2_S61Q
YNSGKLEEFVQGNLERECMEEKCSFEEAREVFENTERTKLFWISYSDGDQCESNPCLNGGQCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1485 - protein, 415 aa, Homo sapiens
  FIX_M2_S61H
YNSGKLEEFVQGNLERECMEEKCSFEEAREVFENTERTKLFWISYSDGDQCESNPCLNGGHCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1486 - protein, 415 aa, Homo sapiens
  FIX_M2_I66N
YNSGKLEEFVQGNLERECMEEKCSFEEAREVFENTERTKLFWISYSDGDQCESNPCLNGGSCKDDNNSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1487 - protein, 415 aa, Homo sapiens
  FIX_M2_I66Q
YNSGKLEEFVQGNLERECMEEKCSFEEAREVFENTERTKLFWISYSDGDQCESNPCLNGGSCKDDQNSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1488 - protein, 415 aa, Homo sapiens
  FIX_M2_I66H
YNSGKLEEFVQGNLERECMEEKCSFEEAREVFENTERTKLFWISYSDGDQCESNPCLNGGSCKDDHNSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1489 - protein, 415 aa, Homo sapiens
  FIX_M2_S68N
YNSGKLEEFVQGNLERECMEEKCSFEEAREVFENTERTKLFWISYSDGDQCESNPCLNGGSCKDDINNYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1490 - protein, 415 aa, Homo sapiens
  FIX_M2_S68Q
YNSGKLEEFVQGNLERECMEEKCSFEEAREVFENTERTKLFWISYSDGDQCESNPCLNGGSCKDDINQYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1491 - protein, 415 aa, Homo sapiens
  FIX_M2_S68H
YNSGKLEEFVQGNLERECMEEKCSFEEAREVFENTERTKLFWISYSDGDQCESNPCLNGGSCKDDINHYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1492 - protein, 415 aa, Homo sapiens
  FIX_M2_G76N
YNSGKLEEFVQGNLERECMEEKCSFEEAREVFENTERTKLFWISYSDGDQCESNPCLNGGSCKDDINSYECWCPFNFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1493 - protein, 415 aa, Homo sapiens
  FIX_M2_G76Q
YNSGKLEEFVQGNLERECMEEKCSFEEAREVFENTERTKLFWISYSDGDQCESNPCLNGGSCKDDINSYECWCPFQFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1494 - protein, 415 aa, Homo sapiens
  FIX_M2_G76H
YNSGKLEEFVQGNLERECMEEKCSFEEAREVFENTERTKLFWISYSDGDQCESNPCLNGGSCKDDINSYECWCPFHFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1495 - protein, 415 aa, Homo sapiens
  FIX_M2_G79N
YNSGKLEEFVQGNLERECMEEKCSFEEAREVFENTERTKLFWISYSDGDQCESNPCLNGGSCKDDINSYECWCPFGFENKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1496 - protein, 415 aa, Homo sapiens
  FIX_M2_G79Q
YNSGKLEEFVQGNLERECMEEKCSFEEAREVFENTERTKLFWISYSDGDQCESNPCLNGGSCKDDINSYECWCPFGFEQKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1497 - protein, 415 aa, Homo sapiens
  FIX_M2_G79H
YNSGKLEEFVQGNLERECMEEKCSFEEAREVFENTERTKLFWISYSDGDQCESNPCLNGGSCKDDINSYECWCPFGFEHKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1498 - protein, 415 aa, Homo sapiens
  FIX_M2_V86N
YNSGKLEEFVQGNLERECMEEKCSFEEAREVFENTERTKLFWISYSDGDQCESNPCLNGGSCKDDINSYECWCPFGFEGKNCELDNTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1499 - protein, 415 aa, Homo sapiens
  FIX_M2_V86Q
YNSGKLEEFVQGNLERECMEEKCSFEEAREVFENTERTKLFWISYSDGDQCESNPCLNGGSCKDDINSYECWCPFGFEGKNCELDQTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1500 - protein, 415 aa, Homo sapiens
  FIX_M2_V86H
YNSGKLEEFVQGNLERECMEEKCSFEEAREVFENTERTKLFWISYSDGDQCESNPCLNGGSCKDDINSYECWCPFGFEGKNCELDHTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1501 - protein, 415 aa, Homo sapiens
  FIX_M2_T87N
YNSGKLEEFVQGNLERECMEEKCSFEEAREVFENTERTKLFWISYSDGDQCESNPCLNGGSCKDDINSYECWCPFGFEGKNCELDVNCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1502 - protein, 415 aa, Homo sapiens
  FIX_M2_T87Q
YNSGKLEEFVQGNLERECMEEKCSFEEAREVFENTERTKLFWISYSDGDQCESNPCLNGGSCKDDINSYECWCPFGFEGKNCELDVQCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1503 - protein, 415 aa, Homo sapiens
  FIX_M2_T87H
YNSGKLEEFVQGNLERECMEEKCSFEEAREVFENTERTKLFWISYSDGDQCESNPCLNGGSCKDDINSYECWCPFGFEGKNCELDVHCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1504 - protein, 415 aa, Homo sapiens
  FIX_M2_I90N
YNSGKLEEFVQGNLERECMEEKCSFEEAREVFENTERTKLFWISYSDGDQCESNPCLNGGSCKDDINSYECWCPFGFEGKNCELDVTCNNKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1505 - protein, 415 aa, Homo sapiens
  FIX_M2_I90Q
YNSGKLEEFVQGNLERECMEEKCSFEEAREVFENTERTKLFWISYSDGDQCESNPCLNGGSCKDDINSYECWCPFGFEGKNCELDVTCNQKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1506 - protein, 415 aa, Homo sapiens
  FIX_M2_I90H
YNSGKLEEFVQGNLERECMEEKCSFEEAREVFENTERTKLFWISYSDGDQCESNPCLNGGSCKDDINSYECWCPFGFEGKNCELDVTCNHKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1507 - protein, 415 aa, Homo sapiens
  FIX_M2_G93N
YNSGKLEEFVQGNLERECMEEKCSFEEAREVFENTERTKLFWISYSDGDQCESNPCLNGGSCKDDINSYECWCPFGFEGKNCELDVTCNIKNNRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1508 - protein, 415 aa, Homo sapiens
  FIX_M2_G93Q
YNSGKLEEFVQGNLERECMEEKCSFEEAREVFENTERTKLFWISYSDGDQCESNPCLNGGSCKDDINSYECWCPFGFEGKNCELDVTCNIKNQRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1509 - protein, 415 aa, Homo sapiens
  FIX_M2_G93H
YNSGKLEEFVQGNLERECMEEKCSFEEAREVFENTERTKLFWISYSDGDQCESNPCLNGGSCKDDINSYECWCPFGFEGKNCELDVTCNIKNHRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1510 - protein, 415 aa, Homo sapiens
  FIX_M2_S102N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNNADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1511 - protein, 415 aa, Homo sapiens
  FIX_M2_S102Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNQADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1512 - protein, 415 aa, Homo sapiens
  FIX_M2_S102H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNHADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1513 - protein, 415 aa, Homo sapiens
  FIX_M2_A103N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSNDNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1514 - protein, 415 aa, Homo sapiens
  FIX_M2_A103Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSQDNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1515 - protein, 415 aa, Homo sapiens
  FIX_M2_A103H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSHDNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1516 - protein, 415 aa, Homo sapiens
  FIX_M2_V107N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKNVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1517 - protein, 415 aa, Homo sapiens
  FIX_M2_V107Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKQVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1518 - protein, 415 aa, Homo sapiens
  FIX_M2_V107H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKHVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1519 - protein, 415 aa, Homo sapiens
  FIX_M2_V108N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVNCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1520 - protein, 415 aa, Homo sapiens
  FIX_M2_V108Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVQCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1521 - protein, 415 aa, Homo sapiens
  FIX_M2_V108H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVHCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1522 - protein, 415 aa, Homo sapiens
  FIX_M2_S110N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCNCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1523 - protein, 415 aa, Homo sapiens
  FIX_M2_S110Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCQCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1524 - protein, 415 aa, Homo sapiens
  FIX_M2_S110H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCHCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1525 - protein, 415 aa, Homo sapiens
  FIX_M2_T112N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCNEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1526 - protein, 415 aa, Homo sapiens
  FIX_M2_T112Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCQEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1527 - protein, 415 aa, Homo sapiens
  FIX_M2_T112H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCHEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1528 - protein, 415 aa, Homo sapiens
  FIX_M2_G114N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTENYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1529 - protein, 415 aa, Homo sapiens
  FIX_M2_G114Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEQYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1530 - protein, 415 aa, Homo sapiens
  FIX_M2_G114H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEHYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1531 - protein, 415 aa, Homo sapiens
  FIX_M2_A118N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLNENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1532 - protein, 415 aa, Homo sapiens
  FIX_M2_A118Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLQENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1533 - protein, 415 aa, Homo sapiens
  FIX_M2_A118H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLHENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1534 - protein, 415 aa, Homo sapiens
  FIX_M2_S123N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKNCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1535 - protein, 415 aa, Homo sapiens
  FIX_M2_S123Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKQCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1536 - protein, 415 aa, Homo sapiens
  FIX_M2_S123H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKHCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1537 - protein, 415 aa, Homo sapiens
  FIX_M2_A127N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPNVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1538 - protein, 415 aa, Homo sapiens
  FIX_M2_A127Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPQVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1539 - protein, 415 aa, Homo sapiens
  FIX_M2_A127H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPHVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1540 - protein, 415 aa, Homo sapiens
  FIX_M2_V128N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPANPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1541 - protein, 415 aa, Homo sapiens
  FIX_M2_V128Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAQPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1542 - protein, 415 aa, Homo sapiens
  FIX_M2_V128H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAHPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1543 - protein, 415 aa, Homo sapiens
  FIX_M2_G133N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCNRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1544 - protein, 415 aa, Homo sapiens
  FIX_M2_G133Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCQRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1545 - protein, 415 aa, Homo sapiens
  FIX_M2_G133H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCHRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1546 - protein, 415 aa, Homo sapiens
  FIX_M2_V135N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRNSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1547 - protein, 415 aa, Homo sapiens
  FIX_M2_V135Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRQSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1548 - protein, 415 aa, Homo sapiens
  FIX_M2_V135H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRHSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1549 - protein, 415 aa, Homo sapiens
  FIX_M2_S136N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVNVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1550 - protein, 415 aa, Homo sapiens
  FIX_M2_S136Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVQVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1551 - protein, 415 aa, Homo sapiens
  FIX_M2_S136H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVHVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1552 - protein, 415 aa, Homo sapiens
  FIX_M2_V137N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSNSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1553 - protein, 415 aa, Homo sapiens
  FIX_M2_V137Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSQSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1554 - protein, 415 aa, Homo sapiens
  FIX_M2_V137H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSHSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1555 - protein, 415 aa, Homo sapiens
  FIX_M2_S138N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVNQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1556 - protein, 415 aa, Homo sapiens
  FIX_M2_S138Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVQQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1557 - protein, 415 aa, Homo sapiens
  FIX_M2_S138H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVHQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1558 - protein, 415 aa, Homo sapiens
  FIX_M2_T140N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQNSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1559 - protein, 415 aa, Homo sapiens
  FIX_M2_T140Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQQSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1560 - protein, 415 aa, Homo sapiens
  FIX_M2_T140H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQHSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1561 - protein, 415 aa, Homo sapiens
  FIX_M2_S141N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTNKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1562 - protein, 415 aa, Homo sapiens
  FIX_M2_S141Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTQKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1563 - protein, 415 aa, Homo sapiens
  FIX_M2_S141H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTHKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1564 - protein, 415 aa, Homo sapiens
  FIX_M2_T144N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLNRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1565 - protein, 415 aa, Homo sapiens
  FIX_M2_T144Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLQRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1566 - protein, 415 aa, Homo sapiens
  FIX_M2_T144H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLHRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1567 - protein, 415 aa, Homo sapiens
  FIX_M2_A146N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRNETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1568 - protein, 415 aa, Homo sapiens
  FIX_M2_A146Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRQETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1569 - protein, 415 aa, Homo sapiens
  FIX_M2_A146H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRHETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1570 - protein, 415 aa, Homo sapiens
  FIX_M2_T148N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAENVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1571 - protein, 415 aa, Homo sapiens
  FIX_M2_T148Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEQVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1572 - protein, 415 aa, Homo sapiens
  FIX_M2_T148H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEHVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1573 - protein, 415 aa, Homo sapiens
  FIX_M2_V149N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETNFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1574 - protein, 415 aa, Homo sapiens
  FIX_M2_V149Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETQFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1575 - protein, 415 aa, Homo sapiens
  FIX_M2_V149H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETHFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1576 - protein, 415 aa, Homo sapiens
  FIX_M2_V153N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDNDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1577 - protein, 415 aa, Homo sapiens
  FIX_M2_V153Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDQDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1578 - protein, 415 aa, Homo sapiens
  FIX_M2_V153H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDHDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1579 - protein, 415 aa, Homo sapiens
  FIX_M2_V156N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYNNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1580 - protein, 415 aa, Homo sapiens
  FIX_M2_V156Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYQNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1581 - protein, 415 aa, Homo sapiens
  FIX_M2_V156H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYHNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1582 - protein, 415 aa, Homo sapiens
  FIX_M2_S158N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNNTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1583 - protein, 415 aa, Homo sapiens
  FIX_M2_S158Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNQTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1584 - protein, 415 aa, Homo sapiens
  FIX_M2_S158H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNHTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1585 - protein, 415 aa, Homo sapiens
  FIX_M2_T159N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSNEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1586 - protein, 415 aa, Homo sapiens
  FIX_M2_T159Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSQEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1587 - protein, 415 aa, Homo sapiens
  FIX_M2_T159H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSHEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1588 - protein, 415 aa, Homo sapiens
  FIX_M2_A161N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTENETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1589 - protein, 415 aa, Homo sapiens
  FIX_M2_A161Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEQETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1590 - protein, 415 aa, Homo sapiens
  FIX_M2_A161H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEHETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1591 - protein, 415 aa, Homo sapiens
  FIX_M2_T163N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1592 - protein, 415 aa, Homo sapiens
  FIX_M2_T163Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEQILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1593 - protein, 415 aa, Homo sapiens
  FIX_M2_T163H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1594 - protein, 415 aa, Homo sapiens
  FIX_M2_I164N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETNLDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1595 - protein, 415 aa, Homo sapiens
  FIX_M2_I164Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1596 - protein, 415 aa, Homo sapiens
  FIX_M2_I164H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETHLDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1597 - protein, 415 aa, Homo sapiens
  FIX_M2_I168N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNNTQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1598 - protein, 415 aa, Homo sapiens
  FIX_M2_I168Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNQTQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1599 - protein, 415 aa, Homo sapiens
  FIX_M2_I168H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNHTQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1600 - protein, 415 aa, Homo sapiens
  FIX_M2_T169N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNINQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1601 - protein, 415 aa, Homo sapiens
  FIX_M2_T169Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIQQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1602 - protein, 415 aa, Homo sapiens
  FIX_M2_T169H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1603 - protein, 415 aa, Homo sapiens
  FIX_M2_S171N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQNTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1604 - protein, 415 aa, Homo sapiens
  FIX_M2_S171Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1605 - protein, 415 aa, Homo sapiens
  FIX_M2_S171H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQHTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1606 - protein, 415 aa, Homo sapiens
  FIX_M2_T172N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSNQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1607 - protein, 415 aa, Homo sapiens
  FIX_M2_T172Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSQQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1608 - protein, 415 aa, Homo sapiens
  FIX_M2_T172H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSHQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1609 - protein, 415 aa, Homo sapiens
  FIX_M2_S174N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQNFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1610 - protein, 415 aa, Homo sapiens
  FIX_M2_S174Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1611 - protein, 415 aa, Homo sapiens
  FIX_M2_S174H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1612 - protein, 415 aa, Homo sapiens
  FIX_M2_T179N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFNRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1613 - protein, 415 aa, Homo sapiens
  FIX_M2_T179Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1614 - protein, 415 aa, Homo sapiens
  FIX_M2_T179H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1615 - protein, 415 aa, Homo sapiens
  FIX_M2_V181N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRNVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1616 - protein, 415 aa, Homo sapiens
  FIX_M2_V181Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRQVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1617 - protein, 415 aa, Homo sapiens
  FIX_M2_V181H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRHVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1618 - protein, 415 aa, Homo sapiens
  FIX_M2_V182N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVNGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1619 - protein, 415 aa, Homo sapiens
  FIX_M2_V182Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVQGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1620 - protein, 415 aa, Homo sapiens
  FIX_M2_V182H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVHGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1621 - protein, 415 aa, Homo sapiens
  FIX_M2_G183N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVNGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1622 - protein, 415 aa, Homo sapiens
  FIX_M2_G183Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVQGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1623 - protein, 415 aa, Homo sapiens
  FIX_M2_G183H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVHGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1624 - protein, 415 aa, Homo sapiens
  FIX_M2_G184N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGNEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1625 - protein, 415 aa, Homo sapiens
  FIX_M2_G184Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGQEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1626 - protein, 415 aa, Homo sapiens
  FIX_M2_G184H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGHEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1627 - protein, 415 aa, Homo sapiens
  FIX_M2_A187N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDNKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1628 - protein, 415 aa, Homo sapiens
  FIX_M2_A187Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDQKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1629 - protein, 415 aa, Homo sapiens
  FIX_M2_A187H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDHKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1630 - protein, 415 aa, Homo sapiens
  FIX_M2_G190N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPNQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1631 - protein, 415 aa, Homo sapiens
  FIX_M2_G190Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPQQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1632 - protein, 415 aa, Homo sapiens
  FIX_M2_G190H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPHQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1633 - protein, 415 aa, Homo sapiens
  FIX_M2_V196N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQNVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1634 - protein, 415 aa, Homo sapiens
  FIX_M2_V196Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQQVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1635 - protein, 415 aa, Homo sapiens
  FIX_M2_V196H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQHVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1636 - protein, 415 aa, Homo sapiens
  FIX_M2_V197N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVNLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1637 - protein, 415 aa, Homo sapiens
  FIX_M2_V197Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVQLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1638 - protein, 415 aa, Homo sapiens
  FIX_M2_V197H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVHLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1639 - protein, 415 aa, Homo sapiens
  FIX_M2_G200N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNNKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1640 - protein, 415 aa, Homo sapiens
  FIX_M2_G200Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNQKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1641 - protein, 415 aa, Homo sapiens
  FIX_M2_G200H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNHKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1642 - protein, 415 aa, Homo sapiens
  FIX_M2_V202N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKNDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1643 - protein, 415 aa, Homo sapiens
  FIX_M2_V202Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKQDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1644 - protein, 415 aa, Homo sapiens
  FIX_M2_V202H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKHDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1645 - protein, 415 aa, Homo sapiens
  FIX_M2_A204N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDNFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1646 - protein, 415 aa, Homo sapiens
  FIX_M2_A204Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDQFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1647 - protein, 415 aa, Homo sapiens
  FIX_M2_A204H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDHFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1648 - protein, 415 aa, Homo sapiens
  FIX_M2_G207N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCNGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1649 - protein, 415 aa, Homo sapiens
  FIX_M2_G207Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCQGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1650 - protein, 415 aa, Homo sapiens
  FIX_M2_G207H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCHGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1651 - protein, 415 aa, Homo sapiens
  FIX_M2_G208N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGNSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1652 - protein, 415 aa, Homo sapiens
  FIX_M2_G208Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGQSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1653 - protein, 415 aa, Homo sapiens
  FIX_M2_G208H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGHSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1654 - protein, 415 aa, Homo sapiens
  FIX_M2_S209N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGNIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1655 - protein, 415 aa, Homo sapiens
  FIX_M2_S209Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGQIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1656 - protein, 415 aa, Homo sapiens
  FIX_M2_S209H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGHIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1657 - protein, 415 aa, Homo sapiens
  FIX_M2_I210N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSNVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1658 - protein, 415 aa, Homo sapiens
  FIX_M2_I210Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSQVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1659 - protein, 415 aa, Homo sapiens
  FIX_M2_I210H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSHVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1660 - protein, 415 aa, Homo sapiens
  FIX_M2_V211N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSINNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1661 - protein, 415 aa, Homo sapiens
  FIX_M2_V211Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIQNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1662 - protein, 415 aa, Homo sapiens
  FIX_M2_V211H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIHNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1663 - protein, 415 aa, Homo sapiens
  FIX_M2_I216N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWNVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1664 - protein, 415 aa, Homo sapiens
  FIX_M2_I216Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWQVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1665 - protein, 415 aa, Homo sapiens
  FIX_M2_I216H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWHVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1666 - protein, 415 aa, Homo sapiens
  FIX_M2_V217N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWINTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1667 - protein, 415 aa, Homo sapiens
  FIX_M2_V217Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIQTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1668 - protein, 415 aa, Homo sapiens
  FIX_M2_V217H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIHTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1669 - protein, 415 aa, Homo sapiens
  FIX_M2_T218N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVNAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1670 - protein, 415 aa, Homo sapiens
  FIX_M2_T218Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVQAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1671 - protein, 415 aa, Homo sapiens
  FIX_M2_T218H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVHAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1672 - protein, 415 aa, Homo sapiens
  FIX_M2_A219N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTNAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1673 - protein, 415 aa, Homo sapiens
  FIX_M2_A219Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTQAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1674 - protein, 415 aa, Homo sapiens
  FIX_M2_A219H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTHAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1675 - protein, 415 aa, Homo sapiens
  FIX_M2_A220N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTANHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1676 - protein, 415 aa, Homo sapiens
  FIX_M2_A220Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAQHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1677 - protein, 415 aa, Homo sapiens
  FIX_M2_A220H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAHHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1678 - protein, 415 aa, Homo sapiens
  FIX_M2_V223N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCNETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1679 - protein, 415 aa, Homo sapiens
  FIX_M2_V223Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCQETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1680 - protein, 415 aa, Homo sapiens
  FIX_M2_V223H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCHETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1681 - protein, 415 aa, Homo sapiens
  FIX_M2_T225N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVENGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1682 - protein, 415 aa, Homo sapiens
  FIX_M2_T225Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEQGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1683 - protein, 415 aa, Homo sapiens
  FIX_M2_T225H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEHGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1684 - protein, 415 aa, Homo sapiens
  FIX_M2_G226N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETNVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1685 - protein, 415 aa, Homo sapiens
  FIX_M2_G226Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETQVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1686 - protein, 415 aa, Homo sapiens
  FIX_M2_G226H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETHVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1687 - protein, 415 aa, Homo sapiens
  FIX_M2_V227N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGNKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1688 - protein, 415 aa, Homo sapiens
  FIX_M2_V227Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGQKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1689 - protein, 415 aa, Homo sapiens
  FIX_M2_V227H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGHKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1690 - protein, 415 aa, Homo sapiens
  FIX_M2_I229N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKNTVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1691 - protein, 415 aa, Homo sapiens
  FIX_M2_I229Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKQTVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1692 - protein, 415 aa, Homo sapiens
  FIX_M2_I229H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKHTVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1693 - protein, 415 aa, Homo sapiens
  FIX_M2_T230N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKINVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1694 - protein, 415 aa, Homo sapiens
  FIX_M2_T230Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKIQVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1695 - protein, 415 aa, Homo sapiens
  FIX_M2_T230H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKIHVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1696 - protein, 415 aa, Homo sapiens
  FIX_M2_V231N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITNVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1697 - protein, 415 aa, Homo sapiens
  FIX_M2_V231Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITQVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1698 - protein, 415 aa, Homo sapiens
  FIX_M2_V231H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITHVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1699 - protein, 415 aa, Homo sapiens
  FIX_M2_V232N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVNAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1700 - protein, 415 aa, Homo sapiens
  FIX_M2_V232Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVQAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1701 - protein, 415 aa, Homo sapiens
  FIX_M2_V232H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVHAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1702 - protein, 415 aa, Homo sapiens
  FIX_M2_A233N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVNGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1703 - protein, 415 aa, Homo sapiens
  FIX_M2_A233Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVQGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1704 - protein, 415 aa, Homo sapiens
  FIX_M2_A233H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVHGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1705 - protein, 415 aa, Homo sapiens
  FIX_M2_G234N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVANEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1706 - protein, 415 aa, Homo sapiens
  FIX_M2_G234Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAQEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1707 - protein, 415 aa, Homo sapiens
  FIX_M2_G234H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAHEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1708 - protein, 415 aa, Homo sapiens
  FIX_M2_I238N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNNEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1709 - protein, 415 aa, Homo sapiens
  FIX_M2_I238Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNQEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1710 - protein, 415 aa, Homo sapiens
  FIX_M2_I238H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNHEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1711 - protein, 415 aa, Homo sapiens
  FIX_M2_T241N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEENEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1712 - protein, 415 aa, Homo sapiens
  FIX_M2_T241Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEEQEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1713 - protein, 415 aa, Homo sapiens
  FIX_M2_T241H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEEHEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1714 - protein, 415 aa, Homo sapiens
  FIX_M2_T244N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHNEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1715 - protein, 415 aa, Homo sapiens
  FIX_M2_T244Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHQEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1716 - protein, 415 aa, Homo sapiens
  FIX_M2_T244H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHHEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1717 - protein, 415 aa, Homo sapiens
  FIX_M2_V250N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNNIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1718 - protein, 415 aa, Homo sapiens
  FIX_M2_V250Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNQIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1719 - protein, 415 aa, Homo sapiens
  FIX_M2_V250H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNHIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1720 - protein, 415 aa, Homo sapiens
  FIX_M2_I251N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVNRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1721 - protein, 415 aa, Homo sapiens
  FIX_M2_I251Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVQRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1722 - protein, 415 aa, Homo sapiens
  FIX_M2_I251H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVHRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1723 - protein, 415 aa, Homo sapiens
  FIX_M2_I253N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRNIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1724 - protein, 415 aa, Homo sapiens
  FIX_M2_I253Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRQIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1725 - protein, 415 aa, Homo sapiens
  FIX_M2_I253H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRHIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1726 - protein, 415 aa, Homo sapiens
  FIX_M2_I254N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRINPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1727 - protein, 415 aa, Homo sapiens
  FIX_M2_I254Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIQPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1728 - protein, 415 aa, Homo sapiens
  FIX_M2_I254H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIHPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1729 - protein, 415 aa, Homo sapiens
  FIX_M2_A261N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNNAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1730 - protein, 415 aa, Homo sapiens
  FIX_M2_A261Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNQAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1731 - protein, 415 aa, Homo sapiens
  FIX_M2_A261H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNHAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1732 - protein, 415 aa, Homo sapiens
  FIX_M2_A262N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNANINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1733 - protein, 415 aa, Homo sapiens
  FIX_M2_A262Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAQINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1734 - protein, 415 aa, Homo sapiens
  FIX_M2_A262H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAHINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1735 - protein, 415 aa, Homo sapiens
  FIX_M2_I263N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAANNKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1736 - protein, 415 aa, Homo sapiens
  FIX_M2_I263Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAQNKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1737 - protein, 415 aa, Homo sapiens
  FIX_M2_I263H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAHNKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1738 - protein, 415 aa, Homo sapiens
  FIX_M2_I270N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDNALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1739 - protein, 415 aa, Homo sapiens
  FIX_M2_I270Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDQALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1740 - protein, 415 aa, Homo sapiens
  FIX_M2_I270H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDHALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1741 - protein, 415 aa, Homo sapiens
  FIX_M2_A271N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDINLLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1742 - protein, 415 aa, Homo sapiens
  FIX_M2_A271Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIQLLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1743 - protein, 415 aa, Homo sapiens
  FIX_M2_A271H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIHLLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1744 - protein, 415 aa, Homo sapiens
  FIX_M2_V280N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLNLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1745 - protein, 415 aa, Homo sapiens
  FIX_M2_V280Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLQLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1746 - protein, 415 aa, Homo sapiens
  FIX_M2_V280H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLHLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1747 - protein, 415 aa, Homo sapiens
  FIX_M2_S283N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNNYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1748 - protein, 415 aa, Homo sapiens
  FIX_M2_S283Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNQYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1749 - protein, 415 aa, Homo sapiens
  FIX_M2_S283H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNHYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1750 - protein, 415 aa, Homo sapiens
  FIX_M2_V285N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYNTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1751 - protein, 415 aa, Homo sapiens
  FIX_M2_V285Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYQTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1752 - protein, 415 aa, Homo sapiens
  FIX_M2_V285H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYHTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1753 - protein, 415 aa, Homo sapiens
  FIX_M2_T286N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVNPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1754 - protein, 415 aa, Homo sapiens
  FIX_M2_T286Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVQPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1755 - protein, 415 aa, Homo sapiens
  FIX_M2_T286H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVHPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1756 - protein, 415 aa, Homo sapiens
  FIX_M2_I288N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPNCIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1757 - protein, 415 aa, Homo sapiens
  FIX_M2_I288Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPQCIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1758 - protein, 415 aa, Homo sapiens
  FIX_M2_I288H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPHCIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1759 - protein, 415 aa, Homo sapiens
  FIX_M2_I290N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICNADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1760 - protein, 415 aa, Homo sapiens
  FIX_M2_I290Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICQADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1761 - protein, 415 aa, Homo sapiens
  FIX_M2_I290H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICHADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1762 - protein, 415 aa, Homo sapiens
  FIX_M2_A291N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICINDKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1763 - protein, 415 aa, Homo sapiens
  FIX_M2_A291Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIQDKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1764 - protein, 415 aa, Homo sapiens
  FIX_M2_A291H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIHDKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1765 - protein, 415 aa, Homo sapiens
  FIX_M2_T296N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYNNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1766 - protein, 415 aa, Homo sapiens
  FIX_M2_T296Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYQNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1767 - protein, 415 aa, Homo sapiens
  FIX_M2_T296H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYHNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1768 - protein, 415 aa, Homo sapiens
  FIX_M2_I298N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNNFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1769 - protein, 415 aa, Homo sapiens
  FIX_M2_I298Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNQFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1770 - protein, 415 aa, Homo sapiens
  FIX_M2_I298H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNHFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1771 - protein, 415 aa, Homo sapiens
  FIX_M2_G303N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFNSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1772 - protein, 415 aa, Homo sapiens
  FIX_M2_G303Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFQSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1773 - protein, 415 aa, Homo sapiens
  FIX_M2_G303H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFHSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1774 - protein, 415 aa, Homo sapiens
  FIX_M2_S304N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGNGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1775 - protein, 415 aa, Homo sapiens
  FIX_M2_S304Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGQGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1776 - protein, 415 aa, Homo sapiens
  FIX_M2_S304H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGHGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1777 - protein, 415 aa, Homo sapiens
  FIX_M2_G305N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSNYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1778 - protein, 415 aa, Homo sapiens
  FIX_M2_G305Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSQYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1779 - protein, 415 aa, Homo sapiens
  FIX_M2_G305H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSHYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1780 - protein, 415 aa, Homo sapiens
  FIX_M2_V307N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYNSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1781 - protein, 415 aa, Homo sapiens
  FIX_M2_V307Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYQSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1782 - protein, 415 aa, Homo sapiens
  FIX_M2_V307H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYHSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1783 - protein, 415 aa, Homo sapiens
  FIX_M2_S308N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVNGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1784 - protein, 415 aa, Homo sapiens
  FIX_M2_S308Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVQGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1785 - protein, 415 aa, Homo sapiens
  FIX_M2_S308H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVHGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1786 - protein, 415 aa, Homo sapiens
  FIX_M2_G309N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSNWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1787 - protein, 415 aa, Homo sapiens
  FIX_M2_G309Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSQWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1788 - protein, 415 aa, Homo sapiens
  FIX_M2_G309H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSHWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1789 - protein, 415 aa, Homo sapiens
  FIX_M2_G311N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWNRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1790 - protein, 415 aa, Homo sapiens
  FIX_M2_G311Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWQRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1791 - protein, 415 aa, Homo sapiens
  FIX_M2_G311H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWHRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1792 - protein, 415 aa, Homo sapiens
  FIX_M2_V313N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRNFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1793 - protein, 415 aa, Homo sapiens
  FIX_M2_V313Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRQFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1794 - protein, 415 aa, Homo sapiens
  FIX_M2_V313H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRHFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1795 - protein, 415 aa, Homo sapiens
  FIX_M2_G317N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKNRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1796 - protein, 415 aa, Homo sapiens
  FIX_M2_G317Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKQRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1797 - protein, 415 aa, Homo sapiens
  FIX_M2_G317H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKHRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1798 - protein, 415 aa, Homo sapiens
  FIX_M2_S319N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRNALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1799 - protein, 415 aa, Homo sapiens
  FIX_M2_S319Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRQALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1800 - protein, 415 aa, Homo sapiens
  FIX_M2_S319H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRHALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1801 - protein, 415 aa, Homo sapiens
  FIX_M2_A320N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSNLVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1802 - protein, 415 aa, Homo sapiens
  FIX_M2_A320Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSQLVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1803 - protein, 415 aa, Homo sapiens
  FIX_M2_A320H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSHLVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1804 - protein, 415 aa, Homo sapiens
  FIX_M2_V322N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALNLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1805 - protein, 415 aa, Homo sapiens
  FIX_M2_V322Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALQLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1806 - protein, 415 aa, Homo sapiens
  FIX_M2_V322H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALHLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1807 - protein, 415 aa, Homo sapiens
  FIX_M2_V328N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRNPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1808 - protein, 415 aa, Homo sapiens
  FIX_M2_V328Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRQPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1809 - protein, 415 aa, Homo sapiens
  FIX_M2_V328H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRHPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1810 - protein, 415 aa, Homo sapiens
  FIX_M2_V331N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLNDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1811 - protein, 415 aa, Homo sapiens
  FIX_M2_V331Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLQDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1812 - protein, 415 aa, Homo sapiens
  FIX_M2_V331H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLHDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1813 - protein, 415 aa, Homo sapiens
  FIX_M2_A334N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRNTCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1814 - protein, 415 aa, Homo sapiens
  FIX_M2_A334Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRQTCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1815 - protein, 415 aa, Homo sapiens
  FIX_M2_A334H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRHTCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1816 - protein, 415 aa, Homo sapiens
  FIX_M2_T335N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRANCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1817 - protein, 415 aa, Homo sapiens
  FIX_M2_T335Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRAQCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1818 - protein, 415 aa, Homo sapiens
  FIX_M2_T335H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRAHCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1819 - protein, 415 aa, Homo sapiens
  FIX_M2_S339N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRNTKFTIYNNMFCAGFHEGGRDSCQGDSGGPHVTEVEGTSFLTGIISWGEECAMKGKYGIYTKVSRYVNWIKEKTKLT

SEQ ID NO: 1820 - protein, 415 aa, Homo sapiens
  FIX_M2_S339Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRQTKFTIYNNMFCAGFHEGGRDSCQGDSGGPHVTEVEGTSFLTGIISWGEECAMKGKYGIYTKVSRYVNWIKEKTKLT

SEQ ID NO: 1821 - protein, 415 aa, Homo sapiens
  FIX_M2_S339H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRHTKFTIYNNMFCAGFHEGGRDSCQGDSGGPHVTEVEGTSFLTGIISWGEECAMKGKYGIYTKVSRYVNWIKEKTKLT

SEQ ID NO: 1822 - protein, 415 aa, Homo sapiens
  FIX_M2_T340N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSNKFTIYNNMFCAGFHEGGRDSCQGDSGGPHVTEVEGTSFLTGIISWGEECAMKGKYGIYTKVSRYVNWIKEKTKLT

SEQ ID NO: 1823 - protein, 415 aa, Homo sapiens
  FIX_M2_T340Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSQKFTIYNNMFCAGFHEGGRDSCQGDSGGPHVTEVEGTSFLTGIISWGEECAMKGKYGIYTKVSRYVNWIKEKTKLT

SEQ ID NO: 1824 - protein, 415 aa, Homo sapiens
  FIX_M2_T340H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSHKFTIYNNMFCAGFHEGGRDSCQGDSGGPHVTEVEGTSFLTGIISWGEECAMKGKYGIYTKVSRYVNWIKEKTKLT

SEQ ID NO: 1825 - protein, 415 aa, Homo sapiens
  FIX_M2_T343N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFNIYNNMFCAGFHEGGRDSCQGDSGGPHVTEVEGTSFLTGIISWGEECAMKGKYGIYTKVSRYVNWIKEKTKLT

SEQ ID NO: 1826 - protein, 415 aa, Homo sapiens
  FIX_M2_T343Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFQIYNNMFCAGFHEGGRDSCQGDSGGPHVTEVEGTSFLTGIISWGEECAMKGKYGIYTKVSRYVNWIKEKTKLT

SEQ ID NO: 1827 - protein, 415 aa, Homo sapiens
  FIX_M2_T343H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFHIYNNMFCAGFHEGGRDSCQGDSGGPHVTEVEGTSFLTGIISWGEECAMKGKYGIYTKVSRYVNWIKEKTKLT

SEQ ID NO: 1828 - protein, 415 aa, Homo sapiens
  FIX_M2_I344N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTNYNNMFCAGFHEGGRDSCQGDSGGPHVTEVEGTSFLTGIISWGEECAMKGKYGIYTKVSRYVNWIKEKTKLT

SEQ ID NO: 1829 - protein, 415 aa, Homo sapiens
  FIX_M2_I344Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTQYNNMFCAGFHEGGRDSCQGDSGGPHVTEVEGTSFLTGIISWGEECAMKGKYGIYTKVSRYVNWIKEKTKLT

SEQ ID NO: 1830 - protein, 415 aa, Homo sapiens
  FIX_M2_I344H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTHYNNMFCAGFHEGGRDSCQGDSGGPHVTEVEGTSFLTGIISWGEECAMKGKYGIYTKVSRYVNWIKEKTKLT

SEQ ID NO: 1831 - protein, 415 aa, Homo sapiens
  FIX_M2_A351N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCNGFHEGGRDSCQGDSGGPHVTEVEGTSFLTGIISWGEECAMKGKYGIYTKVSRYVNWIKEKTKLT

SEQ ID NO: 1832 - protein, 415 aa, Homo sapiens
  FIX_M2_A351Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCQGFHEGGRDSCQGDSGGPHVTEVEGTSFLTGIISWGEECAMKGKYGIYTKVSRYVNWIKEKTKLT

SEQ ID NO: 1833 - protein, 415 aa, Homo sapiens
  FIX_M2_A351H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCHGFHEGGRDSCQGDSGGPHVTEVEGTSFLTGIISWGEECAMKGKYGIYTKVSRYVNWIKEKTKLT

SEQ ID NO: 1834 - protein, 415 aa, Homo sapiens
  FIX_M2_G352N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCANFHEGGRDSCQGDSGGPHVTEVEGTSFLTGIISWGEECAMKGKYGIYTKVSRYVNWIKEKTKLT

SEQ ID NO: 1835 - protein, 415 aa, Homo sapiens
  FIX_M2_G352Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAQFHEGGRDSCQGDSGGPHVTEVEGTSFLTGIISWGEECAMKGKYGIYTKVSRYVNWIKEKTKLT

SEQ ID NO: 1836 - protein, 415 aa, Homo sapiens
  FIX_M2_G352H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAHFHEGGRDSCQGDSGGPHVTEVEGTSFLTGIISWGEECAMKGKYGIYTKVSRYVNWIKEKTKLT

SEQ ID NO: 1837 - protein, 415 aa, Homo sapiens
  FIX_M2_G356N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHENGRDSCQGDSGGPHVTEVEGTSFLTGIISWGEECAMKGKYGIYTKVSRYVNWIKEKTKLT

SEQ ID NO: 1838 - protein, 415 aa, Homo sapiens
  FIX_M2_G356Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEQGRDSCQGDSGGPHVTEVEGTSFLTGIISWGEECAMKGKYGIYTKVSRYVNWIKEKTKLT

SEQ ID NO: 1839 - protein, 415 aa, Homo sapiens
  FIX_M2_G356H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEHGRDSCQGDSGGPHVTEVEGTSFLTGIISWGEECAMKGKYGIYTKVSRYVNWIKEKTKLT

SEQ ID NO: 1840 - protein, 415 aa, Homo sapiens
  FIX_M2_G357N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGNRDSCQGDSGGPHVTEVEGTSFLTGIISWGEECAMKGKYGIYTKVSRYVNWIKEKTKLT

SEQ ID NO: 1841 - protein, 415 aa, Homo sapiens
  FIX_M2_G357Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGQRDSCQGDSGGPHVTEVEGTSFLTGIISWGEECAMKGKYGIYTKVSRYVNWIKEKTKLT

SEQ ID NO: 1842 - protein, 415 aa, Homo sapiens
  FIX_M2_G357H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGHRDSCQGDSGGPHVTEVEGTSFLTGIISWGEECAMKGKYGIYTKVSRYVNWIKEKTKLT

SEQ ID NO: 1843 - protein, 415 aa, Homo sapiens
  FIX_M2_S360N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDNCQGDSGGPHVTEVEGTSFLTGIISWGEECAMKGKYGIYTKVSRYVNWIKEKTKLT

SEQ ID NO: 1844 - protein, 415 aa, Homo sapiens
  FIX_M2_S360Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDQCQGDSGGPHVTEVEGTSFLTGIISWGEECAMKGKYGIYTKVSRYVNWIKEKTKLT

SEQ ID NO: 1845 - protein, 415 aa, Homo sapiens
  FIX_M2_S360H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDHCQGDSGGPHVTEVEGTSFLTGIISWGEECAMKGKYGIYTKVSRYVNWIKEKTKLT

SEQ ID NO: 1846 - protein, 415 aa, Homo sapiens
  FIX_M2_G363N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQNDSGGPHVTEVEGTSFLTGIISWGEECAMKGKYGIYTKVSRYVNWIKEKTKLT

SEQ ID NO: 1847 - protein, 415 aa, Homo sapiens
  FIX_M2_G363Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQQDSGGPHVTEVEGTSFLTGIISWGEECAMKGKYGIYTKVSRYVNWIKEKTKLT

SEQ ID NO: 1848 - protein, 415 aa, Homo sapiens
  FIX_M2_G363H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQHDSGGPHVTEVEGTSFLTGIISWGEECAMKGKYGIYTKVSRYVNWIKEKTKLT

SEQ ID NO: 1849 - protein, 415 aa, Homo sapiens
  FIX_M2_S365N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDNGGPHVTEVEGTSFLTGIISWGEECAMKGKYGIYTKVSRYVNWIKEKTKLT

SEQ ID NO: 1850 - protein, 415 aa, Homo sapiens
  FIX_M2_S365Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDQGGPHVTEVEGTSFLTGIISWGEECAMKGKYGIYTKVSRYVNWIKEKTKLT

SEQ ID NO: 1851 - protein, 415 aa, Homo sapiens
  FIX_M2_S365H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDHGGPHVTEVEGTSFLTGIISWGEECAMKGKYGIYTKVSRYVNWIKEKTKLT

SEQ ID NO: 1852 - protein, 415 aa, Homo sapiens
  FIX_M2_G366N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSNGPHVTEVEGTSFLTGIISWGEECAMKGKYGIYTKVSRYVNWIKEKTKLT

SEQ ID NO: 1853 - protein, 415 aa, Homo sapiens
  FIX_M2_G366Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSQGPHVTEVEGTSFLTGIISWGEECAMKGKYGIYTKVSRYVNWIKEKTKLT

SEQ ID NO: 1854 - protein, 415 aa, Homo sapiens
  FIX_M2_G366H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSHGPHVTEVEGTSFLTGIISWGEECAMKGKYGIYTKVSRYVNWIKEKTKLT

SEQ ID NO: 1855 - protein, 415 aa, Homo sapiens
  FIX_M2_G367N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGNPHVTEVEGTSFLTGIISWGEECAMKGKYGIYTKVSRYVNWIKEKTKLT

SEQ ID NO: 1856 - protein, 415 aa, Homo sapiens
  FIX_M2_G367Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGQPHVTEVEGTSFLTGIISWGEECAMKGKYGIYTKVSRYVNWIKEKTKLT

SEQ ID NO: 1857 - protein, 415 aa, Homo sapiens
  FIX_M2_G367H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGHPHVTEVEGTSFLTGIISWGEECAMKGKYGIYTKVSRYVNWIKEKTKLT

SEQ ID NO: 1858 - protein, 415 aa, Homo sapiens
  FIX_M2_V370N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHNTEVEGTSFLTGIISWGEECAMKGKYGIYTKVSRYVNWIKEKTKLT

SEQ ID NO: 1859 - protein, 415 aa, Homo sapiens
  FIX_M2_V370Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHQTEVEGTSFLTGIISWGEECAMKGKYGIYTKVSRYVNWIKEKTKLT

SEQ ID NO: 1860 - protein, 415 aa, Homo sapiens
  FIX_M2_V370H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHHTEVEGTSFLTGIISWGEECAMKGKYGIYTKVSRYVNWIKEKTKLT

SEQ ID NO: 1861 - protein, 415 aa, Homo sapiens
  FIX_M2_T371N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVNEVEGTSFLTGIISWGEECAMKGKYGIYTKVSRYVNWIKEKTKLT

SEQ ID NO: 1862 - protein, 415 aa, Homo sapiens
  FIX_M2_T371Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVQEVEGTSFLTGIISWGEECAMKGKYGIYTKVSRYVNWIKEKTKLT

SEQ ID NO: 1863 - protein, 415 aa, Homo sapiens
  FIX_M2_T371H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVHEVEGTSFLTGIISWGEECAMKGKYGIYTKVSRYVNWIKEKTKLT

SEQ ID NO: 1864 - protein, 415 aa, Homo sapiens
  FIX_M2_V373N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTENEGTSFLTGIISWGEECAMKGKYGIYTKVSRYVNWIKEKTKLT

SEQ ID NO: 1865 - protein, 415 aa, Homo sapiens
  FIX_M2_V373Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEQEGTSFLTGIISWGEECAMKGKYGIYTKVSRYVNWIKEKTKLT

SEQ ID NO: 1866 - protein, 415 aa, Homo sapiens
  FIX_M2_V373H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEHEGTSFLTGIISWGEECAMKGKYGIYTKVSRYVNWIKEKTKLT

SEQ ID NO: 1867 - protein, 415 aa, Homo sapiens
  FIX_M2_G375N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVENTSFLTGIISWGEECAMKGKYGIYTKVSRYVNWIKEKTKLT

SEQ ID NO: 1868 - protein, 415 aa, Homo sapiens
  FIX_M2_G375Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEQTSFLTGIISWGEECAMKGKYGIYTKVSRYVNWIKEKTKLT

SEQ ID NO: 1869 - protein, 415 aa, Homo sapiens
  FIX_M2_G375H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEHTSFLTGIISWGEECAMKGKYGIYTKVSRYVNWIKEKTKLT

SEQ ID NO: 1870 - protein, 415 aa, Homo sapiens
  FIX_M2_T376N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGNSFLTGIISWGEECAMKGKYGIYTKVSRYVNWIKEKTKLT

SEQ ID NO: 1871 - protein, 415 aa, Homo sapiens
  FIX_M2_T376Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGQSFLTGIISWGEECAMKGKYGIYTKVSRYVNWIKEKTKLT

SEQ ID NO: 1872 - protein, 415 aa, Homo sapiens
  FIX_M2_T376H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGHSFLTGIISWGEECAMKGKYGIYTKVSRYVNWIKEKTKLT

SEQ ID NO: 1873 - protein, 415 aa, Homo sapiens
  FIX_M2_S377N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTNFLTGIISWGEECAMKGKYGIYTKVSRYVNWIKEKTKLT

SEQ ID NO: 1874 - protein, 415 aa, Homo sapiens
  FIX_M2_S377Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTQFLTGIISWGEECAMKGKYGIYTKVSRYVNWIKEKTKLT

SEQ ID NO: 1875 - protein, 415 aa, Homo sapiens
  FIX_M2_S377H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTHFLTGIISWGEECAMKGKYGIYTKVSRYVNWIKEKTKLT

SEQ ID NO: 1876 - protein, 415 aa, Homo sapiens
  FIX_M2_T380N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLNGIISWGEECAMKGKYGIYTKVSRYVNWIKEKTKLT

SEQ ID NO: 1877 - protein, 415 aa, Homo sapiens
  FIX_M2_T380Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLQGIISWGEECAMKGKYGIYTKVSRYVNWIKEKTKLT

SEQ ID NO: 1878 - protein, 415 aa, Homo sapiens
  FIX_M2_T380H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLHGIISWGEECAMKGKYGIYTKVSRYVNWIKEKTKLT

SEQ ID NO: 1879 - protein, 415 aa, Homo sapiens
  FIX_M2_G381N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTNIISWGEECAMKGKYGIYTKVSRYVNWIKEKTKLT

SEQ ID NO: 1880 - protein, 415 aa, Homo sapiens
  FIX_M2_G381Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTQIISWGEECAMKGKYGIYTKVSRYVNWIKEKTKLT

SEQ ID NO: 1881 - protein, 415 aa, Homo sapiens
  FIX_M2_G381H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTHIISWGEECAMKGKYGIYTKVSRYVNWIKEKTKLT

SEQ ID NO: 1882 - protein, 415 aa, Homo sapiens
  FIX_M2_I382N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGNISWGEECAMKGKYGIYTKVSRYVNWIKEKTKLT

SEQ ID NO: 1883 - protein, 415 aa, Homo sapiens
  FIX_M2_I382Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGQISWGEECAMKGKYGIYTKVSRYVNWIKEKTKLT

SEQ ID NO: 1884 - protein, 415 aa, Homo sapiens
  FIX_M2_I382H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGHISWGEECAMKGKYGIYTKVSRYVNWIKEKTKLT

SEQ ID NO: 1885 - protein, 415 aa, Homo sapiens
  FIX_M2_I383N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGINSWGEECAMKGKYGIYTKVSRYVNWIKEKTKLT

SEQ ID NO: 1886 - protein, 415 aa, Homo sapiens
  FIX_M2_I383Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIQSWGEECAMKGKYGIYTKVSRYVNWIKEKTKLT

SEQ ID NO: 1887 - protein, 415 aa, Homo sapiens
  FIX_M2_I383H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIHSWGEECAMKGKYGIYTKVSRYVNWIKEKTKLT

SEQ ID NO: 1888 - protein, 415 aa, Homo sapiens
  FIX_M2_S384N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIINWGEECAMKGKYGIYTKVSRYVNWIKEKTKLT

SEQ ID NO: 1889 - protein, 415 aa, Homo sapiens
  FIX_M2_S384Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIIQWGEECAMKGKYGIYTKVSRYVNWIKEKTKLT

SEQ ID NO: 1890 - protein, 415 aa, Homo sapiens
  FIX_M2_S384H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIIHWGEECAMKGKYGIYTKVSRYVNWIKEKTKLT

SEQ ID NO: 1891 - protein, 415 aa, Homo sapiens
  FIX_M2_G386N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWNEECAMKGKYGIYTKVSRYVNWIKEKTKLT

SEQ ID NO: 1892 - protein, 415 aa, Homo sapiens
  FIX_M2_G386Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWQEECAMKGKYGIYTKVSRYVNWIKEKTKLT

SEQ ID NO: 1893 - protein, 415 aa, Homo sapiens
  FIX_M2_G386H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWHEECAMKGKYGIYTKVSRYVNWIKEKTKLT

SEQ ID NO: 1894 - protein, 415 aa, Homo sapiens
  FIX_M2_A390N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECNMKGKYGIYTKVSRYVNWIKEKTKLT

SEQ ID NO: 1895 - protein, 415 aa, Homo sapiens
  FIX_M2_A390Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECQMKGKYGIYTKVSRYVNWIKEKTKLT

SEQ ID NO: 1896 - protein, 415 aa, Homo sapiens
  FIX_M2_A390H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECHMKGKYGIYTKVSRYVNWIKEKTKLT

SEQ ID NO: 1897 - protein, 415 aa, Homo sapiens
  FIX_M2_G393N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKNKYGIYTKVSRYVNWIKEKTKLT

SEQ ID NO: 1898 - protein, 415 aa, Homo sapiens
  FIX_M2_G393Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKQKYGIYTKVSRYVNWIKEKTKLT

SEQ ID NO: 1899 - protein, 415 aa, Homo sapiens
  FIX_M2_G393H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKHKYGIYTKVSRYVNWIKEKTKLT

SEQ ID NO: 1900 - protein, 415 aa, Homo sapiens
  FIX_M2_G396N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYNIYTKVSRYVNWIKEKTKLT

SEQ ID NO: 1901 - protein, 415 aa, Homo sapiens
  FIX_M2_G396Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYQIYTKVSRYVNWIKEKTKLT

SEQ ID NO: 1902 - protein, 415 aa, Homo sapiens
  FIX_M2_G396H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYHIYTKVSRYVNWIKEKTKLT

SEQ ID NO: 1903 - protein, 415 aa, Homo sapiens
  FIX_M2_I397N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGNYTKVSRYVNWIKEKTKLT

SEQ ID NO: 1904 - protein, 415 aa, Homo sapiens
  FIX_M2_I397Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGQYTKVSRYVNWIKEKTKLT

SEQ ID NO: 1905 - protein, 415 aa, Homo sapiens
  FIX_M2_I397H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGHYTKVSRYVNWIKEKTKLT

SEQ ID NO: 1906 - protein, 415 aa, Homo sapiens
  FIX_M2_T399N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYNKVSRYVNWIKEKTKLT

SEQ ID NO: 1907 - protein, 415 aa, Homo sapiens
  FIX_M2_T399Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYQKVSRYVNWIKEKTKLT

SEQ ID NO: 1908 - protein, 415 aa, Homo sapiens
  FIX_M2_T399H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYHKVSRYVNWIKEKTKLT

SEQ ID NO: 1909 - protein, 415 aa, Homo sapiens
  FIX_M2_V401N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKNSRYVNWIKEKTKLT

SEQ ID NO: 1910 - protein, 415 aa, Homo sapiens
  FIX_M2_V401Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKQSRYVNWIKEKTKLT

SEQ ID NO: 1911 - protein, 415 aa, Homo sapiens
  FIX_M2_V401H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKHSRYVNWIKEKTKLT

SEQ ID NO: 1912 - protein, 415 aa, Homo sapiens
  FIX_M2_S402N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVNRYVNWIKEKTKLT

SEQ ID NO: 1913 - protein, 415 aa, Homo sapiens
  FIX_M2_S402Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVQRYVNWIKEKTKLT

SEQ ID NO: 1914 - protein, 415 aa, Homo sapiens
  FIX_M2_S402H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVHRYVNWIKEKTKLT

SEQ ID NO: 1915 - protein, 415 aa, Homo sapiens
  FIX_M2_V405N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYNNWIKEKTKLT

SEQ ID NO: 1916 - protein, 415 aa, Homo sapiens
  FIX_M2_V405Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYQNWIKEKTKLT

SEQ ID NO: 1917 - protein, 415 aa, Homo sapiens
  FIX_M2_V405H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYHNWIKEKTKLT

SEQ ID NO: 1918 - protein, 415 aa, Homo sapiens
  FIX_M2_I408N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWNKEKTKLT

SEQ ID NO: 1919 - protein, 415 aa, Homo sapiens
  FIX_M2_I408Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWQKEKTKLT

SEQ ID NO: 1920 - protein, 415 aa, Homo sapiens
  FIX_M2_I408H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWHKEKTKLT

SEQ ID NO: 1921 - protein, 415 aa, Homo sapiens
  FIX_M2_T412N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKNKLT

SEQ ID NO: 1922 - protein, 415 aa, Homo sapiens
  FIX_M2_T412Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKQKLT

SEQ ID NO: 1923 - protein, 415 aa, Homo sapiens
  FIX_M2_T412H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKHKLT

SEQ ID NO: 1924 - protein, 415 aa, Homo sapiens
  FIX_M2_T415N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLN

SEQ ID NO: 1925 - protein, 415 aa, Homo sapiens
  FIX_M2_T415Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLQ

SEQ ID NO: 1926 - protein, 415 aa, Homo sapiens
  FIX_M2_T415H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLH

SEQ ID NO: 1927 - protein, 415 aa, Homo sapiens
  FIX_M2_8_T163N/I164N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1928 - protein, 415 aa, Homo sapiens
  FIX_M2_24_I168N/T169N/S171N/T172N/S174N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNNNQNNQNFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1929 - protein, 415 aa, Homo sapiens
  FIX_M2_40_T179N/V181N/V182N/G183N/G184N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFNRNNNNEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1930 - protein, 415 aa, Homo sapiens
  FIX_M2_47_A187N/G190N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDNKPNQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1931 - protein, 415 aa, Homo sapiens
  FIX_M2_54_V196N/V197N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQNNLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1932 - protein, 415 aa, Homo sapiens
  FIX_M2_87_T140N/T144N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQNSKLNRAETVFPDVDYVNSTEAETILDNITQSTQSFNDFTRVNGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1933 - protein, 415 aa, Homo sapiens
  FIX_M2_90_F175I/F178I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSINDITRVNGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1934 - protein, 415 aa, Homo sapiens
  FIX_M2_93_F192I/W194I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQIPIQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1935 - protein, 415 aa, Homo sapiens
  FIX_M2_97_D152N/D154N/T148A
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPNVNYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1936 - protein, 415 aa, Homo sapiens
  FIX_M2_98_T148A/D152N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1937 - protein, 415 aa, Homo sapiens
  FIX_M2_99_T148A/D152Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPQVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1938 - protein, 415 aa, Homo sapiens
  FIX_M2_100_T148A/D154N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1939 - protein, 415 aa, Homo sapiens
  FIX_M2_101_T148A/D154Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVQYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1940 - protein, 415 aa, Homo sapiens; identical to SEQ ID NO: 1935
  FIX_M2_106_D152N/D154N

SEQ ID NO: 1941 - protein, 415 aa, Homo sapiens
  FIX_M2_107_T163H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1942 - protein, 415 aa, Homo sapiens
  FIX_M2_108_I164Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1943 - protein, 415 aa, Homo sapiens
  FIX_M2_109_T163N/I164N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1944 - protein, 415 aa, Homo sapiens
  FIX_M2_110_T169H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1945 - protein, 415 aa, Homo sapiens
  FIX_M2_111_S171Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1946 - protein, 415 aa, Homo sapiens
  FIX_M2_112_S174Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1947 - protein, 415 aa, Homo sapiens
  FIX_M2_113_S174H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1948 - protein, 415 aa, Homo sapiens
  FIX_M2_114_T179Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1949 - protein, 415 aa, Homo sapiens
  FIX_M2_115_T179H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1950 - protein, 415 aa, Homo sapiens
  FIX_M2_116_D166Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1951 - protein, 415 aa, Homo sapiens
  FIX_M2_117_D166N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1952 - protein, 415 aa, Homo sapiens
  FIX_M2_118_D186Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1953 - protein, 415 aa, Homo sapiens
  FIX_M2_119_D186N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1954 - protein, 415 aa, Homo sapiens
  FIX_M2_120_F192I/D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1955 - protein, 415 aa, Homo sapiens
  FIX_M2_121_F192I/D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1956 - protein, 415 aa, Homo sapiens
  FIX_M2_122_T148A/D152N/D154N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1957 - protein, 415 aa, Homo sapiens
  FIX_M2_123_T148A/D154N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1958 - protein, 415 aa, Homo sapiens
  FIX_M2_124_D152N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPNVDYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1959 - protein, 415 aa, Homo sapiens
  FIX_M2_125_D152Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPQVDYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1960 - protein, 415 aa, Homo sapiens
  FIX_M2_126_D154N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVNYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1961 - protein, 415 aa, Homo sapiens
  FIX_M2_127_D154Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVQYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1962 - protein, 415 aa, Homo sapiens
  FIX_M2_128_D152N/D154N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPNVNYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1963 - protein, 415 aa, Homo sapiens
  FIX_M2_141_T163H/D166Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILQNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1964 - protein, 415 aa, Homo sapiens
  FIX_M2_142_T163H/D166N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILNNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1965 - protein, 415 aa, Homo sapiens
  FIX_M2_143_T163H/D186Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1966 - protein, 415 aa, Homo sapiens
  FIX_M2_144_T163H/D186N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1967 - protein, 415 aa, Homo sapiens
  FIX_M2_145_T163H/F192I/D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1968 - protein, 415 aa, Homo sapiens
  FIX_M2_146_T163H/F192I/D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEHILDNITQSTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1969 - protein, 415 aa, Homo sapiens
  FIX_M2_147_T148A/D152N/D154N/T163H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAEHILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1970 - protein, 415 aa, Homo sapiens
  FIX_M2_148_T148A/D154N/T163H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAEHILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1971 - protein, 415 aa, Homo sapiens
  FIX_M2_149_I164Q/D166Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLQNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1972 - protein, 415 aa, Homo sapiens
  FIX_M2_150_I164Q/D166N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLNNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1973 - protein, 415 aa, Homo sapiens
  FIX_M2_151_I164Q/D186Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1974 - protein, 415 aa, Homo sapiens
  FIX_M2_152_I164Q/D186N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1975 - protein, 415 aa, Homo sapiens
  FIX_M2_153_I164Q/F192I/D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1976 - protein, 415 aa, Homo sapiens
  FIX_M2_154_I164Q/F192I/D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETQLDNITQSTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1977 - protein, 415 aa, Homo sapiens
  FIX_M2_155_T148A/D152N/D154N/I164Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETQLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1978 - protein, 415 aa, Homo sapiens
  FIX_M2_156_T148A/D154N/I164Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETQLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1979 - protein, 415 aa, Homo sapiens
  FIX_M2_157_T163N/I164N/D166Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLQNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1980 - protein, 415 aa, Homo sapiens
  FIX_M2_158_T163N/I164N/D166N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLNNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1981 - protein, 415 aa, Homo sapiens
  FIX_M2_159_T163N/I164N/D186Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1982 - protein, 415 aa, Homo sapiens
  FIX_M2_160_T163N/I164N/D186N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1983 - protein, 415 aa, Homo sapiens
  FIX_M2_161_T163N/I164N/F192I/D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1984 - protein, 415 aa, Homo sapiens
  FIX_M2_162_T163N/I164N/F192I/D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAENNLDNITQSTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1985 - protein, 415 aa, Homo sapiens
  FIX_M2_163_T148A/D152N/D154N/T163N/I164N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAENNLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1986 - protein, 415 aa, Homo sapiens
  FIX_M2_164_T148A/D154N/T163N/I164N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAENNLDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1987 - protein, 415 aa, Homo sapiens
  FIX_M2_165_D166Q/T169H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNIHQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1988 - protein, 415 aa, Homo sapiens
  FIX_M2_166_D166N/T169H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNIHQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1989 - protein, 415 aa, Homo sapiens
  FIX_M2_167_T169H/D186Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1990 - protein, 415 aa, Homo sapiens
  FIX_M2_168_T169H/D186N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1991 - protein, 415 aa, Homo sapiens
  FIX_M2_169_T169H/F192I/D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1992 - protein, 415 aa, Homo sapiens
  FIX_M2_170_T169H/F192I/D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIHQSTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1993 - protein, 415 aa, Homo sapiens
  FIX_M2_171_T148A/D152N/D154N/T169H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNIHQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1994 - protein, 415 aa, Homo sapiens
  FIX_M2_172_T148A/D154N/T169H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNIHQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1995 - protein, 415 aa, Homo sapiens
  FIX_M2_173_D166Q/S171Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQQTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1996 - protein, 415 aa, Homo sapiens
  FIX_M2_174_D166N/S171Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQQTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1997 - protein, 415 aa, Homo sapiens
  FIX_M2_175_S171Q/D186Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1998 - protein, 415 aa, Homo sapiens
  FIX_M2_176_S171Q/D186N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 1999 - protein, 415 aa, Homo sapiens
  FIX_M2_177_S171Q/F192I/D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2000 - protein, 415 aa, Homo sapiens
  FIX_M2_178_S171Q/F192I/D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQQTQSFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2001 - protein, 415 aa, Homo sapiens
  FIX_M2_179_T148A/D152N/D154N/S171Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQQTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2002 - protein, 415 aa, Homo sapiens
  FIX_M2_180_T148A/D154N/S171Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQQTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2003 - protein, 415 aa, Homo sapiens
  FIX_M2_181_D166Q/S174Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQQFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2004 - protein, 415 aa, Homo sapiens
  FIX_M2_182_D166N/S174Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQQFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2005 - protein, 415 aa, Homo sapiens
  FIX_M2_183_S174Q/D186Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2006 - protein, 415 aa, Homo sapiens
  FIX_M2_184_S174Q/D186N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2007 - protein, 415 aa, Homo sapiens
  FIX_M2_185_S174Q/F192I/D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2008 - protein, 415 aa, Homo sapiens
  FIX_M2_186_S174Q/F192I/D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQQFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2009 - protein, 415 aa, Homo sapiens
  FIX_M2_187_T148A/D152N/D154N/S174Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQQFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2010 - protein, 415 aa, Homo sapiens
  FIX_M2_188_T148A/D154N/S174Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQQFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2011 - protein, 415 aa, Homo sapiens
  FIX_M2_189_D166Q/S174H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQHFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2012 - protein, 415 aa, Homo sapiens
  FIX_M2_190_D166N/S174H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQHFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2013 - protein, 415 aa, Homo sapiens
  FIX_M2_191_S174H/D186Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2014 - protein, 415 aa, Homo sapiens
  FIX_M2_192_S174H/D186N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2015 - protein, 415 aa, Homo sapiens
  FIX_M2_193_S174H/F192I/D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2016 - protein, 415 aa, Homo sapiens
  FIX_M2_194_S174H/F192I/D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQHFNDFTRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2017 - protein, 415 aa, Homo sapiens
  FIX_M2_195_T148A/D152N/D154N/S174H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQHFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2018 - protein, 415 aa, Homo sapiens
  FIX_M2_196_T148A/D154N/S174H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQHFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2019 - protein, 415 aa, Homo sapiens
  FIX_M2_197_D166Q/T179Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQSFNDFQRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2020 - protein, 415 aa, Homo sapiens
  FIX_M2_198_D166N/T179Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQSFNDFQRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2021 - protein, 415 aa, Homo sapiens
  FIX_M2_199_T179Q/D186Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2022 - protein, 415 aa, Homo sapiens
  FIX_M2_200_T179Q/D186N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2023 - protein, 415 aa, Homo sapiens
  FIX_M2_201_T179Q/F192I/D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2024 - protein, 415 aa, Homo sapiens
  FIX_M2_202_T179Q/F192I/D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFQRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2025 - protein, 415 aa, Homo sapiens
  FIX_M2_203_T148A/D152N/D154N/T179Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQSFNDFQRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2026 - protein, 415 aa, Homo sapiens
  FIX_M2_204_T148A/D154N/T179Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQSFNDFQRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2027 - protein, 415 aa, Homo sapiens
  FIX_M2_205_D166Q/T179H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILQNITQSTQSFNDFHRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2028 - protein, 415 aa, Homo sapiens
  FIX_M2_206_D166N/T179H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILNNITQSTQSFNDFHRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2029 - protein, 415 aa, Homo sapiens
  FIX_M2_207_T179H/D186Q/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGEQAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2030 - protein, 415 aa, Homo sapiens
  FIX_M2_208_T179H/D186N/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGENAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2031 - protein, 415 aa, Homo sapiens
  FIX_M2_209_T179H/F192I/D203Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGEDAKPGQIPWQVVLNGKVQAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2032 - protein, 415 aa, Homo sapiens
  FIX_M2_210_T179H/F192I/D203N
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFHRVVGGEDAKPGQIPWQVVLNGKVNAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2033 - protein, 415 aa, Homo sapiens
  FIX_M2_211_T148A/D152N/D154N/T179H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPNVNYVNSTEAETILDNITQSTQSFNDFHRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2034 - protein, 415 aa, Homo sapiens
  FIX_M2_212_T148A/D154N/T179H/F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVNYVNSTEAETILDNITQSTQSFNDFHRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2035 - protein, 415 aa, Homo sapiens
  FIX_M2 L165Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETIQDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2036 - protein, 415 aa, Homo sapiens
  FIX_M2 L165H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETIHDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2037 - protein, 415 aa, Homo sapiens
  FIX_M2 F175H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSHNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2038 - protein, 415 aa, Homo sapiens
  FIX_M2 F178H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDHTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2039 - protein, 415 aa, Homo sapiens
  FIX_M2 F192H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQHPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2040 - protein, 415 aa, Homo sapiens
  FIX_M2 F192I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQIPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2041 - protein, 415 aa, Homo sapiens
  FIX_M2 F192V
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQVPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2042 - protein, 415 aa, Homo sapiens
  FIX_M2 W194I
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPIQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2043 - protein, 415 aa, Homo sapiens
  FIX_M2 L198Q
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVQNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2044 - protein, 415 aa, Homo sapiens
  FIX_M2 L198H
YNSGKLEEFVQGNLERECMEEKCSFEEAREVFENTERTKLFWISYSDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVHNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

What is claimed is:

1. A modified factor IX (FIX) polypeptide, comprising an amino acid replacement that corresponds to the amino acid replacement D85N in the FIX polypeptide set forth in SEQ ID NO: 2 or 1035, wherein:

corresponding residues are identified by alignment;

the modified FIX polypeptide comprises a sequence of amino acid residues that is at least 95% identical to an amino acid sequence selected from among the sequences set forth in SEQ ID NOs: 2, 892, 893, 898, 899, 901-905, 909-912 and 1035; and the modified FIX polypeptide retains coagulant activity.

2. The modified FIX polypeptide of claim 1, wherein the FIX polypeptide comprises an amino acid replacement at a position corresponding to an amino acid position selected from among Y1, S3, G4, K5, L6, E7, E8, F9, V10, G12, L14, E15, R16, E17, M19, E20, E21, K22, S24, F25, E26, E27, A28, R29, E30, V31, F32, E33, T35, T38, F41, W42, K43, Y45, V46, D47, G48, D49, E52, S53, P55, L57, N58, G59, G60, K63, D64, D65, I66, Y69, W72, F75, G76, F77, E78, G79, E83, L84, V86,190, K91, N92, G93, R94, E96, F98, K100, A103, D104, K106, V107, V108, S110, T112, E113, G114, Y115, R116, L117, A118, 8123, A127, V128, P131, G133, V135, V137, S138, T140, S141, K142, L143, S145, A146, T148, V149, D152, V153, D154, Y155, V156, S158, T159, E160, A161, E162, T163, I164, L165, I168, F175, F178, T179, R180, V181, V182, G183, G184, E185, D186, A187, K188, P189, G190, F192, P193, W194, V196, V197, L198, N199, G200, K201, V202, D203, A204, F205, G207, G208, S209, I210, V211, E213, K214, W215, I216, V217, T218, A219, A220, V223, G226, V227, K228, I229, T230, V231, V232, A233, G234, E235, I238, E239, E240, E245, R248, V250, I251, R252, I253, I254, P255, Y259, A261, A262, I263, K265, Y266, D269, I270, A271, L272, L273, E274, L275, D276, E277, P278, L279, V280, L281, S283, Y284, V285, T286, P287, I288, I290, A291, D292, K293, Y295, T296, I298, F299, L300, K301, F302, G303, S304, G305, Y306, V307, S308, G309, W310, G311, R312, V313, F314, K316, G317, R318, S319, A320, L321, V322, L323, Y325, L326, R327, V328, P329, L330, V331, D332, R333, A334, T335, L337, R338, S339, T340, K341, F342, T343, I344, Y345, M348, F349, A351, G352, F353, E355, G356, G357, R358, D359, S360, G363, D364, S365, G366, G367, P368, V370, V373, E374, G375, T376, S377, F378, L379, T380, G381, I382, I383, S384, W385, G386, E387, E388, A390, M391, K392, G393, K394, Y395, G396, I397, Y398, T399, K400, V401, S402, R403, Y404, V405, W407, I408, K409, E410, K411, T412, K413, and T415 of the FIX polypeptide set forth in SEQ ID NO: 2 or 1035.

3. The modified FIX polypeptide of claim 2, wherein:
the amino acid replacement corresponds to a replacement selected from among Y1H, Y1I, S3Q, S3H, S3N, G4Q, G4H, G4N, K5N, K5Q, L6I, L6V, E7Q, E7H, E7N, E8Q, E8H, E8N, F9I, F9V, V10Q, V10H, V10N, G12Q, G12H, G12N, L14I, L14V, E15Q, E15H, E15N, R16H, R16Q, E17Q, E17H, E17N, M19I, M19V, E20Q, E20H, E20N, E21Q, E21H, E21N, K22N, K22Q, S24Q, S24H, S24N, F25I, F25V, E26Q, E26H, E26N, E27Q, E27H, E27N, A28Q, A28H, A28N, R29H, R29Q, E30Q, E30H, E30N, V31Q, V31H, V31N, F32I, F32V, E33Q, E33H, E33N, T35Q, T35H, T35N, T38Q, T38H, T38N, F41I, F41N, W42S, W42H, K43N, K43Q, Y45H, Y45I, V46Q, V46H, V46N, D47N, D47Q, G48Q, G48H, G48N, D49N, D49Q, E52Q, E52H, E52N, S53Q, S53H, S53N, P55A, P55S, L57I, L57V, N58Q, N58S, G59Q, G59H, G59N, G60Q, G60H, G60N, K63N, K63Q, D64N, D64Q, D65N, D65Q, I66Q, I66H, I66N, Y69H, Y69I, W72S, W72H, F75I, F75V, G76Q, G76H, G76N, F77I, F77V, E78Q, E78H, E78N, G79Q, G79H, G79N, E83Q, E83H, E83N, L84I, L84V, V86Q, V86H, V86N, I90Q, I90H, I90N, K91N, K91Q, N92Q, N92S, G93Q, G93H, G93N, R94H, R94Q, E96Q, E96H, E96N, F98I, F98V, K100N, K100Q, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L117I, L117V, A118Q, A118H, A118N, S123Q, S123H, S123N, A127Q, A127H, A127N, V128Q, V128H, V128N, P131A, P131S, G133Q, G133H, G133N, V135Q, V135H, V135N, V137Q, V137H, V137N, S138Q, S138H, S138N, T140Q, T140H, T140N, S141Q, S141H, S141N, K142N, K142Q, L143I, L143V, R145H, R145Q, A146Q, A146H, A146N, T148Q, T148H, T148N, V149Q, V149H, V149N, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, I168Q, I168H, I168N, F175I, F175V, F175H, F178I, F178V, F178H, T179Q, T179H, T179N, R180H, R180Q, V181Q, V181H, V181N, V182Q, V182H, V182N, G183Q, G183H, G183N, G184Q, G184H, G184N, E185Q, E185H, E185N, D186N, D186Q, A187Q, A187H, A187N, K188N, K188Q, P189A, P189S, G190Q, G190H, G190N, F192I, F192V, F192H, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203N, D203Q, A204Q, A204H, A204N, F205I, F205V, G207Q, G207H, G207N, G208Q, G208H, G208N, S209Q, S209H, S209N, I210Q, I210H, I210N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, E245Q, E245H, E245N, R248H, R248Q, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, Y295H, Y295I, T296Q, T296H, T296N, I298Q, I298H, I298N, F299I, F299V, L300I, L300V, K301N, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316N, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332N, D332Q, R333H, R333Q, A334Q, A334H, A334N, T335Q, T335H, T335N, L337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351N, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, S365Q, S365H, S365N, G366Q, G366H, G366N, G367Q, G367H, G367N, P368A, P368S, V370Q, V370H, V370N, V373Q, V373H, V373N, E374Q, E374H, E374N, G375Q, G375H, G375N, T376Q, T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395H, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E410Q, E410H, E410N, K411N, K411Q, T412Q, T412H, T412N, K413N, K413Q, T415Q, T415H, and T415N of the FIX polypeptide set forth in SEQ ID NO: 2 or 1035.

4. The modified FIX polypeptide of claim 3, wherein the amino acid replacement is F192I.

5. The modified FIX polypeptide of claim 1, wherein the polypeptide exhibits increased protease resistance compared to the unmodified polypeptide.

6. The modified FIX polypeptide of claim 5, wherein the increased protease resistance is exhibited by the modified FIX polypeptide when it is administered orally or is present in the digestive tract or in the bloodstream.

7. The modified FIX polypeptide of claim 1, wherein the unmodified FIX polypeptide has a sequence of amino acids set forth in SEQ ID NO: 2.

8. The modified FIX polypeptide of claim 1, wherein the unmodified FIX polypeptide has a sequence of amino acids set forth in SEQ ID NO: 1035.

9. The modified FIX polypeptide of claim 1 having a sequence of amino acids set forth in SEQ ID NO: 113 or 1145.

10. The modified FIX polypeptide of claim 9, wherein the unmodified FIX polypeptide is a human polypeptide.

11. The modified FIX polypeptide of claim 9, wherein the unmodified FIX polypeptide is a non-human polypeptide.

12. The modified FIX polypeptide of claim 1, wherein the amino acid sequence of the unmodified polypeptide is selected from among a sequence set forth in SEQ ID NOs: 892, 893, 898-899, 902-905 and 912.

13. The modified FIX polypeptide of claim 1, wherein the modified FIX polypeptide comprises 2, 3, 4, or 5 amino acid replacements compared to the unmodified polypeptide, wherein the unmodified polypeptide comprises the sequence of amino acids set forth in SEQ ID NO: 2 or 1035.

14. The modified FIX polypeptide of claim 1, wherein the polypeptide is a naked polypeptide chain.

15. The modified FIX polypeptide of claim 1, wherein the modified FIX polypeptide is glycosylated, carboxylated, hydroxylated, sulfated, phosphorylated, albuminated, or conjugated to a polyethylene glycol (PEG) moiety.

16. The modified FIX polypeptide of claim 1, comprising an amino acid modification that contributes to an altered property selected from among glycosylation, carboxylation, hydroxylation, sulfation, phosphorylation, PEGylation and a modification to decrease immunogenicity upon administration to a human.

17. The modified FIX polypeptide of claim 2, wherein the amino acid replacement is selected from among natural amino acids, non-natural amino acids and a combination of natural and non-natural amino acids.

18. The modified FIX polypeptide of claim 1, wherein the modified FIX polypeptide is a mature polypeptide.

19. The modified FIX polypeptide of claim 1, wherein the modified FIX polypeptide is a precursor polypeptide.

20. The modified FIX polypeptide of claim 19, wherein the modified FIX polypeptide comprises a signal peptide.

21. The modified FIX polypeptide of claim 1, wherein the modified FIX polypeptide lacks a signal peptide.

22. The modified FIX polypeptide of claim 1, wherein the modified FIX polypeptide comprises a propeptide.

23. The modified FIX polypeptide of claim 1, wherein the modified FIX polypeptide lacks a propeptide.

24. The modified FIX polypeptide of claim 1, wherein the modified FIX polypeptide is a zymogen.

25. The modified FIX polypeptide of claim 1, wherein the modified FIX polypeptide is an activated FIX polypeptide.

26. The modified FIX polypeptide of claim 1, wherein the modified FIX polypeptide is secreted.

27. The modified FIX polypeptide of claim 1, wherein the modified FIX polypeptide comprises a heavy chain and/or a light chain.

28. The modified FIX polypeptide of claim 1, wherein the unmodified FIX polypeptide is an allelic or species variant of the polypeptide set forth in SEQ ID NO: 2 or 1035.

29. The modified FIX polypeptide of claim 1, wherein the amino acid replacement corresponding to D85N in the FIX polypeptide set forth in SEQ ID NO: 2 or 1035 is the only amino acid replacement in the modified polypeptide.

30. A pharmaceutical composition, comprising the modified FIX polypeptide of claim 1.

31. A pharmaceutical composition, comprising a modified FIX polypeptide having a sequence of amino acids set forth in SEQ ID NO: 113 or 1145.

32. The pharmaceutical composition of claim 30, wherein the pharmaceutical composition is formulated for local, systemic or topical administration.

33. The pharmaceutical composition of claim 32, wherein it is formulated for oral, nasal, pulmonary, buccal, transdermal, subcutaneous, intraduodenal, enteral, parenteral, intravenous, or intramuscular administration.

34. The pharmaceutical composition of claim 33, wherein the pharmaceutical composition is formulated for oral administration.

35. The pharmaceutical composition of claim 30, wherein the pharmaceutical composition is formulated for oral administration and does not include exogenously added protease inhibitors.

36. The pharmaceutical composition of claim 30, wherein the amino acid replacement corresponding to D85N in the FIX polypeptide of SEQ ID NO: 2 or 1035 is the only amino acid replacement in the modified FIX polypeptide.

37. The pharmaceutical composition of claim 30, wherein the modified FIX polypeptide is glycosylated, carboxylated, hydroxylated, sulfated, phosphorylated, albuminated, or conjugated to a polyethylene glycol (PEG) moiety.

38. The pharmaceutical composition of claim 30, wherein the polypeptide comprises an amino acid modification, wherein the amino acid modification:
(a) alters a property selected from among glycosylation, carboxylation, hydroxylation, sulfation, phosphorylation and PEGylation; and/or
(b) decreases immunogenicity upon administration to a human.

39. The pharmaceutical composition of claim 38, wherein the one or more additional amino acid modifications are selected from among substitutions with natural amino acids, substitutions with non-natural amino acids and substitutions with a combination of natural and non-natural amino acids.

40. The pharmaceutical composition of claim 38, wherein the one or more additional amino acid modifications increase stability of the FIX polypeptide compared to the unmodified FIX polypeptide.

41. The pharmaceutical composition of claim 30, wherein the pharmaceutical composition is formulated for administration in a form selected from among a liquid, a pill, a tablet, a lozenge and a capsule.

42. The pharmaceutical composition of claim 41, wherein the tablet or capsule is enterically coated.

43. The pharmaceutical composition of claim 30, wherein the pharmaceutical composition is formulated for controlled-release of the modified FIX polypeptide.

44. The pharmaceutical composition of claim 41, wherein the pill, tablet, lozenge, or capsule delivers the modified FIX polypeptide to the mucosa of the mouth, throat, or gastrointestinal tract.

45. The pharmaceutical composition of claim 41, wherein the pill, tablet, lozenge, or capsule delivers the modified FIX polypeptide to the gastrointestinal tract.

46. The pharmaceutical composition of claim 45, wherein the modified FIX polypeptide exhibits increased protein half-life or bioavailability in the gastrointestinal tract compared to the unmodified FIX polypeptide that does not contain the amino acid replacement.

47. The pharmaceutical composition of claim 30, wherein the pharmaceutical composition does not contain exogenously added protease inhibitors.

48. The pharmaceutical composition of claim 30, wherein the pharmaceutical composition contains exogenously added protease inhibitors.

49. The pharmaceutical composition of claim 48, wherein the protease inhibitor is selected from among a Bowman-Birk inhibitor, a conjugated Bowman-Birk inhibitor, aprotinin, and camostat.

50. A method, comprising treating a subject by administering the pharmaceutical composition of claim 30, wherein the subject has a disease or condition that is treated by administration of FIX.

51. The method of claim 50, wherein the disease or condition is treated by administration of inactive FIX or active FIX.

52. The method of claim 50, wherein the disease or condition to be treated is selected from among hemophilia, thrombotic disease, and hemorrhagic disease.

53. The method of claim 50, wherein the condition to be treated is disseminated intravascular coagulation (DIC).

54. The method of claim 52, wherein the hemophilia is hemophilia B.

55. The method of claim 52, wherein the hemophilia is congenital.

56. The method of claim 52, wherein the hemophilia is acquired.

57. The method of claim 52, further comprising administration of one or more additional coagulation factors.

58. The method of claim 57, wherein the one or more additional coagulation factors is selected from among factor VIII, factor VII, vitamin K, procoagulants, platelet activators, vasoconstriction agents, plasminogen inhibitors, and fibrolytic inhibitors.

59. The method of claim 52, wherein the thrombotic disease and hemorrhagic disease comprise ischemia, stroke, atherosclerosis, antithrombin III deficiency, or protein C deficiency.

60. The method of claim 59, further comprising administration of one or more additional antithrombogenic factors.

61. The method of claim 60, wherein the one or more additional antithrombogenic factors is selected from among anticoagulants, platelet inhibitors, vasodilators, and fibrolytic activators.

62. The method of claim 61, wherein the anticoagulant is selected from among heparin, coumarin, and hirudin.

63. The method of claim 61, wherein the platelet inhibitor is selected from among aspirin, naproxen, meclofenamic acid, ibuprofen, indomethacin, phenylbutazare, and ticlopidine.

64. The method of claim 61, wherein the fibrolytic activator is selected from among streptokinase, urokinase, and tissue plasminogen activator (t-PA).

65. A kit, comprising the pharmaceutical composition of claim 30, a device for administration of the composition and, optionally, instructions for administration.

* * * * *

UNITED STATES PATENT AND TRADEMARK OFFICE
CERTIFICATE OF CORRECTION

| | | |
|---|---|---|
| PATENT NO. | : 8,383,388 B2 | Page 1 of 1 |
| APPLICATION NO. | : 11/818985 | |
| DATED | : February 26, 2013 | |
| INVENTOR(S) | : Oyhenart et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 987 days.

Signed and Sealed this
Fourteenth Day of January, 2014

Michelle K. Lee
*Deputy Director of the United States Patent and Trademark Office*

UNITED STATES PATENT AND TRADEMARK OFFICE
CERTIFICATE OF CORRECTION

PATENT NO. : 8,383,388 B2
APPLICATION NO. : 11/818985
DATED : February 26, 2013
INVENTOR(S) : Jorge Oyhenart et al.

Page 1 of 1

It is certified that error appears in the above-identified patent and that said Letters Patent is hereby corrected as shown below:

This certificate supersedes Certificate of Correction issued September 21, 2010. The Certificate of Correction is vacated since there were not any patent term adjustments made to the patent after issuance. The Certificate of Correction was published in error and should not have been issued. The [*] Notice is reinstated to read as follows:

On the Title Page:

The first or sole Notice should read --

Subject to any disclaimer, the term of this patent is extended or adjusted under 35 U.S.C. 154(b) by 1,113 days.

Signed and Sealed this
Eleventh Day of February, 2014

Michelle K. Lee
*Deputy Director of the United States Patent and Trademark Office*

UNITED STATES PATENT AND TRADEMARK OFFICE
CERTIFICATE OF CORRECTION

| | | |
|---|---|---|
| PATENT NO. | : 8,383,388 B2 | Page 1 of 1 |
| APPLICATION NO. | : 11/818985 | |
| DATED | : February 26, 2013 | |
| INVENTOR(S) | : Jorge Oyhenart et al. | |

It is certified that error appears in the above-identified patent and that said Letters Patent is hereby corrected as shown below:

This certificate supersedes the Certificates of Correction issued January 14, 2014 and February 11, 2014. The Certificates of Correction are vacated since there were not any patent term adjustments made to the patent after issuance. The Certificates of Correction were published in error and should not have been issued. The [*] Notice is reinstated to read as follows:
--Subject to any disclaimer, the term of this patent is extended or adjusted under 35 U.S.C. 154(b) by 1,113 days.--

Signed and Sealed this
Eighteenth Day of February, 2014

Michelle K. Lee
*Deputy Director of the United States Patent and Trademark Office*

UNITED STATES PATENT AND TRADEMARK OFFICE
CERTIFICATE OF CORRECTION

PATENT NO. : 8,383,388 B2
APPLICATION NO. : 11/818985
DATED : February 26, 2013
INVENTOR(S) : Oyhenart et al.

It is certified that error appears in the above-identified patent and that said Letters Patent is hereby corrected as shown below:

IN THE SPECIFICATION:

At column 3, line 42, please replace "L61" with —L6I—;

at column 3, line 46, please replace "F321" with —F32I—;

at column 3, line 53, please replace "L841" with —L84I—;

at column 3, line 57, please replace "L171" with —L117I—;

at column 5, lines 21-22, please replace "amino acid amino acid replacements" with —amino acid replacements—;

at column 5, line 24, please replace "L61" with —L6I—;

at column 5, line 25, please replace "F91" with —F9I—;

at column 5, line 26, please replace "L141" with —L14I—;

at column 5, line 29, please replace "F251" with —F25I—;

at column 5, line 31, please replace "F321" with —F32I—;

at column 5, line 34, please replace "F411" with —F41I—;

at column 5, line 40, please replace "166N" with —I66N—;

at column 5, line 40, please replace "Y691" with —Y69I—;

at column 5, line 41, please replace "F751" with —F75I—;

at column 5, line 42, please replace "F771" with —F77I—;

at column 5, line 43, please replace "L841" with —L84I—;

at column 5, line 47, please replace "S107Q" with —S102Q—;

at column 5, line 52, please replace "L171" with —L117I—;

at column 7, line 54, please replace "L61" with —L6I—;

at column 7, line 55, please replace "F91" with —F9I—;

at column 7, line 61, please replace "F321" with —F32I—;

Signed and Sealed this
Twenty-seventh Day of May, 2014

Michelle K. Lee
*Deputy Director of the United States Patent and Trademark Office*

CERTIFICATE OF CORRECTION (continued)
U.S. Pat. No. 8,383,388 B2 at column 7, line 63, please replace "Y451" with —Y45I—;

at column 7, line 65, please replace "L571" with —L57I—;

at column 8, line 52, please replace "L841" with —L84I—;

at column 9, line 13, please replace "G3.67N" with —G367N—;

at column 10, line 16, please replace "F91" with —F9I—;

at column 10, line 17, please replace "L141" with —L14I—;

at column 10, line 18, please replace "M191" with —M19I—;

at column 10, line 20, please replace "S24N1, F251" with —S24N, F25I—;

at column 10, line 26, please replace "Y451" with —Y45I—;

at column 10, line 28, please replace "L571" with —L57I—;

at column 10, line 31, please replace "Y691" with —Y69I—;

at column 10, line 32, please replace "F751" with —F75I—;

at column 10, line 33, please replace "F771" with —F77I—;

at column 10, line 34, please replace "L841" with —L84I—;

at column 15, line 45, please replace "L61" with —L6I—;

at column 15, line 46, please replace "F91" with —F9I—;

at column 15, line 47, please replace "L141" with —L14I—;

at column 15, line 48, please replace "M191" with —M19I—;

at column 15, line 50, please replace "F251" with —F25I—;

at column 15, line 52, please replace "F321" with —F32I—;

at column 15, line 54, please replace "Y451" with —Y45I—;

at column 15, line 56, please replace "L571" with —L57I—;

at column 15, line 58, please replace "166Q" with —I66Q—;

at column 15, line 59, please replace "Y691" with —Y69I—;

at column 16, line 1, please replace "L1717" with —L117I—;

at column 16, line 20, please replace "F-192H" with —F192H—;

at column 16, line 26, please replace "I12N" with —1210N—;

at column 17, line 23, please replace "polypeptides chains" with —polypeptide chain—;

at column 22, line 47, please replace "L61" with —L6I—;

at column 22, line 49, please replace "L141" with —L14I—;

at column 22, line 53, please replace "V311H" with —V31H—;

at column 22, line 59, please replace "L571" with —L57I—;

at column 23, line 7, please replace "L171" with —L117I—;

at column 24, line 35, please replace "T415 Q" with —T415Q—;

at column 24, line 51, please replace "190N" with —I90N—;

CERTIFICATE OF CORRECTION (continued)
U.S. Pat. No. 8,383,388 B2 at column 24, line 54, please replace "G 114Q" with —G114Q—;

at column 24, line 54, please replace "A 118Q" with —A118Q—;

at column 76, line 7, please replace "R94;" with —R94,—;

at column 79, line 58, please replace "L61" with —L6I—;

at column 79, line 61, please replace "M191" with —M19I—;

at column 79, line 62, please replace "F251" with —F25I—;

at column 79, line 65, please replace "F321" with —F32I—;

at column 80, line 58, please replace "Y691" with —Y69I—;

at column 80, line 59, please replace "F751" with —F75I—;

at column 80, line 61, please replace "L841" with —L84I—;

at column 81, line 26, please replace "F192IH" with —F192H—;

at column 85, line 31, please replace "T35' Q" with —T35Q—;

at column 85, line 37, please replace "I190N" with —I90N—;

at column 85, line 38, please replace "S102N;" with —S102N,—;

at column 88, line 55, please replace "F91" with —F9I—;

at column 88, line 56, please replace "L141" with —L14I—;

at column 88, line 57, please replace "M191" with —M19I—;

at column 88, line 59, please replace "F251" with —F25I—;

at column 88, line 64, please replace "F411" with —F41I—;

at column 88, line 65, please replace "Y451" with —Y45I—;

at column 89, line 3, please replace "Y691" with —Y69I—;

at column 89, line 5, please replace "F771" with —F77I—;

at column 89, line 6, please replace "L841" with —L84I—;

at column 92, line 50, please replace "I164N/D186Q/F1921" with —I164N/D186Q/F192I—;

at columns 97-98, Table 8, line 31, please replace "181K" with —V181K—;

at columns 97-98, Table 8, line 79, please replace "260G" with —N260G—; and at column 105, line 31, please replace "Ca2+" with —$Ca^{2+}$—.

IN THE CLAIMS:

Column 159, line 62, to column 161, line 13 should read

2. The modified FIX polypeptide of claim 1, wherein the FIX polypeptide comprises an amino acid replacement at a position corresponding to an amino acid position selected from among Y1, S3, G4, K5, L6, E7, E8, F9, V10, G12, L14, E15, R16,

CERTIFICATE OF CORRECTION (continued)  Page 4 of 6
U.S. Pat. No. 8,383,388 B2

E17, M19, E20, E21, K22, S24, F25, E26, E27, A28, R29, E30, V31, F32, E33, T35, T38, F41, W42, K43, Y45, V46, D47, G48, D49, E52, S53, P55, L57, N58, G59, G60, K63, D64, D65, I66, Y69, W72, F75, G76, F77, E78, G79, E83, L84, V86, I90, K91, N92, G93, R94, E96, F98, K100, A103, D104, K106, V107, V108, S110, T112, E113, G114, Y115, R116, L117, A118, S123, A127, V128, P131, G133, V135, V137, S138, T140, S141, K142, L143, R145, A146, T148, V149, D152, V153, D154, Y155, V156, S158, T159, E160, A161, E162, T163, I164, L165, I168, F175, F178, T179, R180, V181, V182, G183, G184, E185, D186, A187, K188, P189, G190, F192, P193, W194, V196, V197, L198, N199, G200, K201, V202, D203, A204, F205, G207, G208, S209, I210, V211, E213, K214, W215, I216, V217, T218, A219, A220, V223, G226, V227, K228, I229, T230, V231, V232, A233, G234, E235, I238, E239, E240, E245, R248, V250, I251, R252, I253, I254, P255, Y259, A261, A262, I263, K265, Y266, D269, I270, A271, L272, L273, E274, L275, D276, E277, P278, L279, V280, L281, S283, Y284, V285, T286, P287, I288, I290, A291, D292, K293, Y295, T296, I298, F299, L300, K301, F302, G303, S304, G305, Y306, V307, S308, G309, W310, G311, R312, V313, F314, K316, G317, R318, S319, A320, L321, V322, L323, Y325, L326, R327, V328, P329, L330, V331, D332, R333, A334, T335, L337, R338, S339, T340, K341, F342, T343, I344, Y345, M348, F349, A351, G352, F353, E355, G356, G357, R358, D359, S360, G363, D364, S365, G366, G367, P368, V370, V373, E374, G375, T376, S377, F378, L379, T380, G381, I382, I383, S384, W385, G386, E387, E388, A390, M391, K392, G393, K394, Y395, G396, I397, Y398, T399, K400, V401, S402, R403, Y404, V405, W407, I408, K409, E410, K411, T412, K413, and T415 of the FIX polypeptide set forth in SEQ ID NO: 2 or 1035.

Column 161, line 14, to column 163, line 5 should read

3. The modified FIX polypeptide of claim 2, wherein:

the amino acid replacement corresponds to a replacement selected from among Y1H, Y1I, S3Q, S3H, S3N, G4Q, G4H, G4N, K5N, K5Q, L6I, L6V, E7Q, E7H, E7N, E8Q, E8H, E8N, F9I, F9V, V10Q, V10H, V10N, G12Q, G12H, G12N, L14I, L14V, E15Q, E15H, E15N, R16H, R16Q, E17Q, E17H, E17N, M19I, M19V, E20Q, E20H, E20N, E21Q, E21H, E21N, K22N, K22Q, S24Q, S24H, S24N, F25I, F25V, E26Q, E26H, E26N, E27Q, E27H, E27N, A28Q, A28H, A28N, R29H, R29Q, E30Q, E30H, E30N, V31Q, V31H, V31N, F32I, F32V, E33Q, E33H, E33N, T35Q, T35H, T35N, T38Q, T38H, T38N, F41I, F41V, W42S, W42H, K43N, K43Q, Y45H, Y45I, V46Q, V46H, V46N, D47N, D47Q, G48Q, G48H, G48N, D49N, D49Q, E52Q, E52H, E52N, S53Q, S53H, S53N, P55A, P55S, L57I, L57V, N58Q, N58S, G59Q, G59H, G59N, G60Q, G60H, G60N, K63N, K63Q, D64N, D64Q, D65N, D65Q, I66Q, I66H, I66N, Y69H, Y69I, W72S, W72H, F75I, F75V, G76Q, G76H, G76N, F77I, F77V, E78Q, E78H, E78N, G79Q, G79H, G79N, E83Q, E83H, E83N, L84I, L84V, V86Q, V86H, V86N, I90Q, I90H, I90N, K91N, K91Q, N92Q, N92S, G93Q, G93H, G93N, R94H, R94Q, E96Q, E96H, E96N, F98I, F98V, K100N, K100Q, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L117I, L117V, A118Q, A118H, A118N, S123Q, S123H, S123N, A127Q, A127H, A127N, V128Q, V128H, V128N, P131A, P131S, G133Q, G133H, G133N, V135Q, V135H, V135N, V137Q, V137H, V137N, S138Q, S138H, S138N, T140Q, T140H, T140N, S141Q, S141H, S141N, K142N, K142Q, L143I, L143V, R145H, R145Q, A146Q, A146H, A146N, T148Q, T148H, T148N, V149Q, V149H, V149N, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, I168Q, I168H, I168N, F175I, F175V, F175H, F178I, F178V, F178H, T179Q, T179H, T179N, R180H, R180Q, V181Q, V181H, V181N, V182Q, V182H, V182N,

CERTIFICATE OF CORRECTION (continued)
U.S. Pat. No. 8,383,388 B2

G183Q, G183H, G183N, G184Q, G184H, G184N, E185Q, E185H, E185N, D186N, D186Q, A187Q, A187H, A187N, K188N, K188Q, P189A, P189S, G190Q, G190H, G190N, F192I, F192V, F192H, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203N, D203Q, A204Q, A204H, A204N, F205I, F205V, G207Q, G207H, G207N, G208Q, G208H, G208N, S209Q, S209H, S209N, I210Q, I210H, I210N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, E245Q, E245H, E245N, R248H, R248Q, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, Y295H, Y295I, T296Q, T296H, T296N, I298Q, I298H, I298N, F299I, F299V, L300I, L300V, K301N, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316N, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332N, D332Q, R333H, R333Q, A334Q, A334H, A334N, T335Q, T335H, T335N, L337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351N, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, S365Q, S365H, S365N, G366Q, G366H, G366N, G367Q, G367H, G367N, P368A, P368S, V370Q, V370H, V370N, V373Q, V373H, V373N, E374Q, E374H, E374N, G375Q, G375H, G375N, T376Q, T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395H, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E410Q, E410H, E410N, K411N, K411Q, T412Q, T412H, T412N, K413N, K413Q, T415Q, T415H, and T415N of the FIX polypeptide set forth in SEQ ID NO: 2 or 1035.

CERTIFICATE OF CORRECTION (continued)
U.S. Pat. No. 8,383,388 B2

Column 163, line 6 to line 7 should read

4. The modified FIX polypeptide of claim 3, wherein the amino acid replacement is F192I.

Column 163, line 23 to line 24 should read

10. The modified FIX polypeptide of claim 1, wherein the unmodified FIX polypeptide is a human polypeptide.

UNITED STATES PATENT AND TRADEMARK OFFICE
CERTIFICATE OF CORRECTION

PATENT NO. : 8,383,388 B2
APPLICATION NO. : 11/818985
DATED : February 26, 2013
INVENTOR(S) : Oyhenart et al.

Page 1 of 6

It is certified that error appears in the above-identified patent and that said Letters Patent is hereby corrected as shown below:

IN THE SPECIFICATION:

at column 3, line 42, please replace "L61" with —L6I—;

at column 3, line 46, please replace "F321" with —F32I—;

at column 3, line 53, please replace "L841" with —L84I—;

at column 3, line 57, please replace "L171" with —L117I—;

at column 5, lines 21-22, please replace "amino acid amino acid replacements" with —amino acid replacements—;

at column 5, line 24, please replace "L61" with —L6I—;

at column 5, line 25, please replace "F91" with —F9I—;

at column 5, line 26, please replace "L141" with —L14I—;

at column 5, line 29, please replace "F251" with —F25I—;

at column 5, line 31, please replace "F321" with —F32I—;

at column 5, line 34, please replace "F411" with —F41I—;

at column 5, line 40, please replace "166N" with —I66N—;

at column 5, line 40, please replace "Y691" with —Y69I—;

at column 5, line 41, please replace "F751" with —F75I—;

at column 5, line 42, please replace "F771" with —F77I—;

at column 5, line 43, please replace "L841" with —L84I—;

at column 5, line 47, please replace "S107Q" with —S102Q—;

at column 5, line 52, please replace "L171" with —L117I—;

at column 7, line 54, please replace "L61" with —L6I—;

This certificate supersedes the Certificate of Correction issued May 27, 2014.

Signed and Sealed this
Ninth Day of September, 2014

Michelle K. Lee
*Deputy Director of the United States Patent and Trademark Office* at column 7, line 55, please replace "F91" with —F9I—;
at column 7, line 61, please replace "F321" with —F32I—;
at column 7, line 63, please replace "Y451" with —Y45I—;
at column 7, line 65, please replace "L571" with —L57I—;
at column 8, line 52, please replace "L841" with —L84I—;
at column 9, line 13, please replace "G3.67N" with —G367N—;
at column 10, line 16, please replace "F91" with —F9I—;
at column 10, line 17, please replace "L141" with —L14I—;
at column 10, line 18, please replace "M191" with —M19I—;
at column 10, line 20, please replace "S24N1, F251" with —S24N, F25I—;
at column 10, line 26, please replace "Y451" with —Y45I—;
at column 10, line 28, please replace "L571" with —L57I—;
at column 10, line 31, please replace "Y691" with —Y69I—;
at column 10, line 32, please replace "F751" with —F75I—;
at column 10, line 33, please replace "F771" with —F77I—;
at column 10, line 34, please replace "L841" with —L84I—;
at column 15, line 45, please replace "L61" with —L6I—;
at column 15, line 46, please replace "F91" with —F9I—;
at column 15, line 47, please replace "L141" with —L14I—;
at column 15, line 48, please replace "M191" with —M19I—;
at column 15, line 50, please replace "F251" with —F25I—;
at column 15, line 52, please replace "F321" with —F32I—;
at column 15, line 54, please replace "Y451" with —Y45I—;
at column 15, line 56, please replace "L571" with —L57I—;
at column 15, line 58, please replace "166Q" with —I66Q—;
at column 15, line 59, please replace "Y691" with —Y69I—;
at column 16, line 1, please replace "L1717" with —L117I—;
at column 16, line 20, please replace "F-192H" with —F192H—;
at column 16, line 26, please replace "I12N" with —I210N—;
at column 17, line 23, please replace "polypeptides chains" with —polypeptide chain—;
at column 22, line 47, please replace "L61" with —L6I—;
at column 22, line 49, please replace "L141" with —L14I—;
at column 22, line 53, please replace "V311H" with —V31H—;
at column 22, line 59, please replace "L571" with —L57I—;
at column 23, line 7, please replace "L171" with —L117I—;

CERTIFICATE OF CORRECTION (continued)
U.S. Pat. No. 8,383,388 B2 at column 24, line 35, please replace "T415 Q" with —T415Q—;

at column 24, line 51, please replace "190N" with —I90N—;

at column 24, line 54, please replace "G 114Q" with —G114Q—;

at column 24, line 54, please replace "A 118Q" with —A118Q—;

at column 76, line 7, please replace "R94;" with —R94,—;

at column 79, line 58, please replace "L61" with —L6I—;

at column 79, line 61, please replace "M191" with —M19I—;

at column 79, line 62, please replace "F251" with —F25I—;

at column 79, line 65, please replace "F321" with —F32I—;

at column 80, line 58, please replace "Y691" with —Y69I—;

at column 80, line 59, please replace "F751" with —F75I—;

at column 80, line 61, please replace "L841" with —L84I—;

at column 81, line 26, please replace "F192IH" with —F192H—;

at column 85, line 31, please replace "T35' Q" with —T35Q—;

at column 85, line 37, please replace "I190N" with —I90N—;

at column 85, line 38, please replace "S102N;" with —S102N,—;

at column 88, line 55, please replace "F91" with —F9I—;

at column 88, line 56, please replace "L141" with —L14I—;

at column 88, line 57, please replace "M191" with —M19I—;

at column 88, line 59, please replace "F251" with —F25I—;

at column 88, line 64, please replace "F411" with —F41I—;

at column 88, line 65, please replace "Y451" with —Y45I—;

at column 89, line 3, please replace "Y691" with —Y69I—;

at column 89, line 5, please replace "F771" with —F77I—;

at column 89, line 6, please replace "L841" with —L84I—;

at column 92, line 50, please replace "I164N/D186Q/F1921" with —I164N/D186Q/F192I—;

at columns 97-98, Table 8, line 31, please replace "181K" with —V181K—;

at columns 97-98, Table 8, line 79, please replace "260G" with —N260G—; and at column 105, line 31, please replace "Ca2+" with —$Ca^{2+}$—.

IN THE CLAIMS:

Column 159, line 62, to column 161, line 13 should read

2.  The modified FIX polypeptide of claim 1, wherein the FIX polypeptide comprises an amino acid replacement at a position corresponding to an amino acid position selected from among Y1, S3, G4, K5, L6, E7, E8, F9, V10, G12, L14, E15, R16,

CERTIFICATE OF CORRECTION (continued)
U.S. Pat. No. 8,383,388 B2

E17, M19, E20, E21, K22, S24, F25, E26, E27, A28, R29, E30, V31, F32, E33, T35, T38, F41, W42, K43, Y45, V46, D47, G48, D49, E52, S53, P55, L57, N58, G59, G60, K63, D64, D65, I66, Y69, W72, F75, G76, F77, E78, G79, E83, L84, V86, I90, K91, N92, G93, R94, E96, F98, K100, A103, D104, K106, V107, V108, S110, T112, E113, G114, Y115, R116, L117, A118, S123, A127, V128, P131, G133, V135, V137, S138, T140, S141, K142, L143, R145, A146, T148, V149, D152, V153, D154, Y155, V156, S158, T159, E160, A161, E162, T163, I164, L165, I168, F175, F178, T179, R180, V181, V182, G183, G184, E185, D186, A187, K188, P189, G190, F192, P193, W194, V196, V197, L198, N199, G200, K201, V202, D203, A204, F205, G207, G208, S209, I210, V211, E213, K214, W215, I216, V217, T218, A219, A220, V223, G226, V227, K228, I229, T230, V231, V232, A233, G234, E235, I238, E239, E240, E245, R248, V250, I251, R252, I253, I254, P255, Y259, A261, A262, I263, K265, Y266, D269, I270, A271, L272, L273, E274, L275, D276, E277, P278, L279, V280, L281, S283, Y284, V285, T286, P287, I288, I290, A291, D292, K293, Y295, T296, I298, F299, L300, K301, F302, G303, S304, G305, Y306, V307, S308, G309, W310, G311, R312, V313, F314, K316, G317, R318, S319, A320, L321, V322, L323, Y325, L326, R327, V328, P329, L330, V331, D332, R333, A334, T335, L337, R338, S339, T340, K341, F342, T343, I344, Y345, M348, F349, A351, G352, F353, E355, G356, G357, R358, D359, S360, G363, D364, S365, G366, G367, P368, V370, V373, E374, G375, T376, S377, F378, L379, T380, G381, I382, I383, S384, W385, G386, E387, E388, A390, M391, K392, G393, K394, Y395, G396, I397, Y398, T399, K400, V401, S402, R403, Y404, V405, W407, I408, K409, E410, K411, T412, K413, and T415 of the FIX polypeptide set forth in SEQ ID NO: 2 or 1035.

Column 161, line 14, to column 163, line 5 should read

3. The modified FIX polypeptide of claim 2, wherein:

the amino acid replacement corresponds to a replacement selected from among Y1H, Y1I, S3Q, S3H, S3N, G4Q, G4H, G4N, K5N, K5Q, L6I, L6V, E7Q, E7H, E7N, E8Q, E8H, E8N, F9I, F9V, V10Q, V10H, V10N, G12Q, G12H, G12N, L14I, L14V, E15Q, E15H, E15N, R16H, R16Q, E17Q, E17H, E17N, M19I, M19V, E20Q, E20H, E20N, E21Q, E21H, E21N, K22N, K22Q, S24Q, S24H, S24N, F25I, F25V, E26Q, E26H, E26N, E27Q, E27H, E27N, A28Q, A28H, A28N, R29H, R29Q, E30Q, E30H, E30N, V31Q, V31H, V31N, F32I, F32V, E33Q, E33H, E33N, T35Q, T35H, T35N, T38Q, T38H, T38N, F41I, F41V, W42S, W42H, K43N, K43Q, Y45H, Y45I, V46Q, V46H, V46N, D47N, D47Q, G48Q, G48H, G48N, D49N, D49Q, E52Q, E52H, E52N, S53Q, S53H, S53N, P55A, P55S, L57I, L57V, N58Q, N58S, G59Q, G59H, G59N, G60Q, G60H, G60N, K63N, K63Q, D64N, D64Q, D65N, D65Q, I66Q, I66H, I66N, Y69H, Y69I, W72S, W72H, F75I, F75V, G76Q, G76H, G76N, F77I, F77V, E78Q, E78H, E78N, G79Q, G79H, G79N, E83Q, E83H, E83N, L84I, L84V, V86Q, V86H, V86N, I90Q, I90H, I90N, K91N, K91Q, N92Q, N92S, G93Q, G93H, G93N, R94H, R94Q, E96Q, E96H, E96N, F98I, F98V, K100N, K100Q, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L117I, L117V, A118Q, A118H, A118N, S123Q, S123H, S123N, A127Q, A127H, A127N, V128Q, V128H, V128N, P131A, P131S, G133Q, G133H, G133N, V135Q, V135H, V135N, V137Q, V137H, V137N, S138Q, S138H, S138N, T140Q, T140H, T140N, S141Q, S141H, S141N, K142N, K142Q, L143I, L143V, R145H, R145Q, A146Q, A146H, A146N, T148Q, T148H, T148N, V149Q, V149H, V149N, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, I168Q, I168H, I168N, F175I, F175V, F175H, F178I, F178V, F178H, T179Q, T179H, T179N, R180H, R180Q, V181Q, V181H, V181N, V182Q, V182H, V182N,

CERTIFICATE OF CORRECTION (continued)
U.S. Pat. No. 8,383,388 B2

G183Q, G183H, G183N, G184Q, G184H, G184N, E185Q, E185H, E185N, D186N, D186Q, A187Q, A187H, A187N, K188N, K188Q, P189A, P189S, G190Q, G190H, G190N, F192I, F192V, F192H, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203N, D203Q, A204Q, A204H, A204N, F205I, F205V, G207Q, G207H, G207N, G208Q, G208H, G208N, S209Q, S209H, S209N, I210Q, I210H, I210N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, E245Q, E245H, E245N, R248H, R248Q, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, Y295H, Y295I, T296Q, T296H, T296N, I298Q, I298H, I298N, F299I, F299V, L300I, L300V, K301N, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316N, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332N, D332Q, R333H, R333Q, A334Q, A334H, A334N, T335Q, T335H, T335N, L337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351N, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, S365Q, S365H, S365N, G366Q, G366H, G366N, G367Q, G367H, G367N, P368A, P368S, V370Q, V370H, V370N, V373Q, V373H, V373N, E374Q, E374H, E374N, G375Q, G375H, G375N, T376Q, T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395H, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E410Q, E410H, E410N, K411N, K411Q, T412Q, T412H, T412N, K413N, K413Q, T415Q, T415H, and T415N of the FIX polypeptide set forth in SEQ ID NO: 2 or 1035.

CERTIFICATE OF CORRECTION (continued)
U.S. Pat. No. 8,383,388 B2

Column 163, line 6 to line 7 should read

4. The modified FIX polypeptide of claim 3, wherein the amino acid replacement is F192I.

Column 163, line 23 to line 24 should read

10. The modified FIX polypeptide of claim 1, wherein the unmodified FIX polypeptide is a human polypeptide.